United States Patent 10,233,495 (METHODS AND COMPOSITIONS FOR SCREENING AND TREATING DEVELOPMENTAL DISORDERS) - sequence listing, part 31

SEQ ID NO: 299 - DNA, 1023163 bp, Homo sapiens
agtgggaaaataaagttgtgtttcttggactaaactcatcagataaattctcttggctgtaagtatttagacctcagggttagctaaaactaagcaatcagattatcttgagatactcacatttttcagataattgttcccatataaaatttccctcgtcctcctctgcagttgatcttggatgagctaatgagaaatgaaccatgcaatatgttattaatttattgggttatcctccattaccctaaagttgatcaataaaaattaaatcattaaggggccaaagtatttttagaaacaatacccaaaacacctggattatagaattctgttcacaagtttaaagtccaaaggaaagaatgcatcccacccctaccagcacttccataaaaacaatcctccagctgggcgcggtggctcacgcctgtaatcccagcactttgggtggccaatgcgggcagatcacaaggtcaggagatcgagaccatcctggctaacatggtgaaaccccatctctactaaaaatacaaaaaattagccgggcgtggtggcaggtgcctgtagtcccagctacccgggaggctgaggcaggagaatggcaagaacccaggagttggaggttgcagtgacccgagaccgcaccactgcactccagcctgggcaacagagcgagactgtgtctcaaaaaaaaaaaaaaaaaaaaaaagattaaaacttgctacccaaagtttacttttcctttctcctcctaacctctgatgatcttcaataatttagaaaaaatgcaaagatttctctttatcttctatgccataaaactataacccaaacaataccaagaaaaagcttgctaatatagggcttgttcattcagaagctgcaggaactctgtggcaaactcgtatgtcaggtcactttgttccatctgggaccataagtccactaactcataaagaacaatagcagacactgtgattctaagagaattggtcactttcatcacagcatagaatgaccgaagccttgtgtagattcgttccattcctcaccgccactcagcatcagtgtaaccattctcaggcagcagaagaagagacctgccaaggctgcatagctggcgatggataaaggatgtggctccctttgtggctgatgtttggctcttgataccattgctgtccctctgtagttatagatctgtatctagtctctggatctagatctagtcctggatttggagctagtctctggatctgaatctagtcctagttctggatctagtctctggatctggatctagtcttgcttctagatctagtcctggctctggatctagtcctggttctggatctagtctctggatctagatctagtcctggatttcgatctagtcctggttctcagtctagtcctggttctgaatctagtgctggatctggacctagtcctggttctggatctagtcctggtctggatctagtctctggatccaaatctagtctctggatctggatctagtccccattctggatctagtccccgttctggatccagtcctggatttggatctagtcctggcattggatctagtctctggttttggatctagtcctggatctggaactagtcttaatttctcctcctatttttgccttttccttgctccttggatttgctgactgcccttagcttctctgatctgaccctgtggggtctcttacagggctgattcatactcatgcaccttcctctacatcctctctaccaccaacagggaggcaaggcccttccttctccaccctctcagccctcttgtctgcgcagggctcactctgccttctgagcgtttgggctgtcactttccctaagaagatgccctgataaaaactctggttccttttcagcctaggtttagcaagtccaatttctgtccctggtaatatgagcatgtttcattggaggatgaaaatctccatttagctgggatcactaatctttctgcaaagccccatagcacatgtatattatccatgatttcgaaaaggtagtaaagttaaaaaaaaaaaaaaaagtaacccacatatgttggagttacacaattctagtcccatgtgggtgtggccaaagccattaatcctctaggcctccatgtccttatctgtcaaacaagcattaggatgcctactctgcagggttgctgggaataatggacataataaaagtgtgaggcctctggacacctgaccaggaggggcactgaatcattggtgggatgaacataggtccatcctgggcacttcactcatgcccatctgatttgtgtccttaaaactctgtgcacactgaaaatcaacaaagaaaacagtagagttaaactacacactccatctagtaggcctaactgatatttacagaacattttactcaaatgctgcagaatacacgttcttttcacctgtacatggaacattctctagaatagaccatatcttaggccacaaaacaagtgtgtacaaattaaaaaaaaaaaaaaacagaaattatatcaagaatcacagctgcctctccaaaactctttgttttgatctgtctcatctacatttggccattgctattttattgctactcaaagtgatgtccctggacaagtagcaacgtcctcacccgggagcttgcaaggaaatgtggagcttcagattcttccctggacctagtgactcagcatctgactttcaccagatccccagtgattcctgtgcatactgaagttcgagaagcactgctctatttcacacttcctctataattaccatctgtcattcctgtcctattatatctgttatctgatgtattaggctcctattgctgctgtaacagatttctgcaaacttagcagcttaaaacaatacaaatgtattctcttgaacttctggcagccagaaatctgaaatcagtttcttgggctgaacccaaagtgttcgcaggaccgtgctccctccggaggctctgggggagaatttgttcctctgccttccagcttctagcacttcatttcttggctcatgcctcctttccccatctccaagccagcagtatagcaccttgcttcagtattcacactgccacgtggtccctcctcttaccatccattaaaaggacagttgtaattacactgagggcccacctgcatattccaagataatcttcctatctgaagatccttaacttaatcacatctgcaatgttccttttaaggaaacattcacaggttctaggggttagaatgtgggtgttttggggggctattatacagcctgttatacctgggtctctaatttggcacttagtaggtctttaataaaagttgaaatttgtattcatttagtggctgtcacaattagtatatgctcacctggagatgccttcatggagaaaggcaagtaaataaattgactataacctatcgtaatccagtatgaatgaatgtatcccttaggtttatatgtttccaatggcaggaagtagttaatctcaaaggctttacaaaagtggtgagctaagtcctgaaaaatgattagaaatgcagcaggtgaccaagacagggagagacattccaaacagcagaaacagcatttgaaagtgcataaaagaagacatgaaacagcaaagcccatccagggagctgtagcgattaggtaaactagagtgtatatatgaagccagagagatcagaagataaagcaaagaagtcagtaagaatcacattaggaaatgctttgaatgactcaccaaggacactgatgttcatcctgtagataggaggctaccattaaagggttaaaatcaggtcattgacaaggtcagaagtaattgaagaaaggtcattctggtaacagtttggaggctatttcaaaagctcagagcaattaaattaacttttcagtttatggtaggtgtttgaataaatatctgctcaatatctctcatatgcaccatcacgcttgaactgctggagaaaaaggcacccagaataacaaaatgttctgttccaagcagatgcctctctgatctgagctgggggtgcagctgtttggtggtaatcaacatgccagttgctgtttcaatcctttttaactggagaggggacaccaggtattaagtggcaagagagctcttagggcagcaggcctggaaggcacctggattccttcaagataagctcagcctgctgcctgctcagtgtttctcagattcaggtttgtgttggtcttggttgttttcacctcttggccattgtgaataatgctgcaattaacatgaggatactaatatctcttcgagatcttgattccaattcttttgggtaaatacctcgaagtagaattactggatcatttgggagttctattttttttttttttttttgagatgaaatgtcattcttgttacccaggctggagtgcaatggcactatcttggctcactgcaacctccgcctactgggttcaagccattctcttgcttcagcctcccaagtagctgggattacaggcatgtgccaccacgcccagctaattttttgtatttttagtagagatagggtttcactatgttggccaggctggtctcaaactcctgacctcgtgatccgcctgcctgggcctcccaaagtgacaggattacaggcgagagccaccgcccccagcctggtagatctatttttaaatttatgagtaacctccatattcttttccacggtggcttcaccatttttcatttcgaccagtagcgtacaaggcctccaatttctccatatccttgtcaacacttgttgtcttgtgtagctaacacttcttaaacccttattacatttgaaatgtgctaagtggaagtgtaatgtgctaccaaatttaaatgatggagaaatagcacctgagagataccatcacacaatgacacatgtactgaaccaagcactgaagttttgcatttgctggattctcatccctgatttctacaaaccaattccagcctcagtttagtcaactgtctgtagagatcagtgactctttggacactaacacccatttttcccaatagttatattaaggatcaaaagtgctaaagccctttgcaaactggacagatatcagttacttacttgtttacaattctggaaaggcacactttgcaaagaggttggaaaaacgcaaaactctcagctttgttctttcatcaaagaaggcaaatatgaaagtcatcatgtttcttgcttcacaaaacacgacctgacataacaaggctttgtgccaaaaaacaaactaacttatttctttccaaagaagccaatgtatgtagctgtctggccacctaagagacatgcatctttaagcagaggtttgtcccctccagagatacttgagacatcagtgccaagcctgagaagcccattactacaaccacctacccaggaaagatagggatgtttgatataaagtgctcttggctgagaaagtttgagtctctattcatgccagttctgcctgctcttagctttcctggcaaatccttggctcatgaaaacttaaggacaaaatggtagaagattcatgtggttggtgcctatgagtgagaagtctggagtcgaatatcagaaggaagacctctacagaatggaccccaatgaacacgcatgagaaactttacctacagagacagccaatatgggcatgcaccaaagatgcagacaatctagataattcttcagttgtgtccccacattgtccttacctccaatctttattcacactgtcccttcccagttaatgtccagcccatatgaccatctcatcaaatccaggccatccttcaacgctgccttctgtataaactcctatgatgccaacctgccatctttcttttcccttcctccttccctctcttaccccagttttggtcccacagcacttttatggtacttcaacccaattcaacagaaatgtggattccaagattacaacacaataaatcccttgagatgcataattatatagaggaaagtgcatggactcaaatcctgctttgcctctcaccagctgtgtgagcaaattccttaaccacatgccatgcagaatctgacataaagaggctgggatttggggctgcagtgctaggttttaatcctggctctaatacgtagcatctgtgtgattttggacacgtcactaacctctctaagcctccacatccatacctgtaagttgaggcaataactgtcttctggccaggcgcagtggctcaagcctgtaatcccagcactttgggaggccgaggcgggcagatcacgaggtcaggagatcgagaccatcctggcacggtaaaaccccatctccactaaaaaaaaaaaaaatacaaaaaaatttagccgagtgtggtggcaggcccctgtagtcccagctactcgggaggctgaggcaggagaatggtgtgaacctgggaggcggaacttgcagtgagccaagactgtgccactgcactccagcctgggcgacagagcaagaatccatctaaaacaataataataataataataacagtgtcttctttcaggagcagctgtaaggatgagtgagttaacaggatgggcacactggatggtaacaccactggtatccgaggtgcagtttccccatctcaggactatcgtgaggactgagggaaaggctgtgtgtgaggtttctaggactgtccatggcagcatgagtggctccataaatgtgcttcttctccttgactagagaacacatttatggatcctcaatccttcttgctcattcttgggcaccgtctctgtgctttgcacataatagattcttagatcaggtcagaataccacttcagaagcaggttaaccaacattccagagagctgaggggcccaggccagacctaatttcctgaagtgggaaatttctcccagaaggggagaagatgccacatgaagtcaacttgcagctggtggggagtatacaggaggcatggggatagggcactgcagccagggtttggcaggttgagatttacctcacacctccctgaatttatttatttatccattcattcattcactagtgaagcaagacctcttcttttcttctctgagcttactaagcccaatgaaaaatttttgtcttcaacaactccctctgaaacatcaacttggcaagactcagatgccttgactgtagcctcccaaaacaccacgtcatggggactgaccactctctccagacaggctgcagggcaaggagcagggccagctgacgtggaagttccctggcacaccaggcaacggggcctgtagtcttatggaaaaacactgggctcagggccaagttcctgcactccagcctcagtcctcacatttgctgtgtgtccttgggtgaaacactctacttttggggtgggtgatggtgtgtgtgtgtgtgtgtgtgtgtgtgtgtgtgtgtgtgcaagcatttacttaaatacggcccagctatgatcccagtcccaacaccctactgagggccttgcattcaggatctccttccatctttgcaacagccttatctgatggagctgggatttgaaccagtgtcagcaggcctccagaggtcatggtttttgtctctgagtatttctcaaaggaagtccacgtgtaaaccttctctatgaattttgaaatagttatgttctatctctactgctattttcaaacttttttttaagagggagtcttgctctgtcatccaggctaaagtgcagtgttacaatctctgctcactgcagcctctgcctcctgggctcaagcaattctcctgcctcagcctcctgagtagctgggattacaggtgcacaccaccatgcccagctaatttttttttgaatttttagtagatacagggttccgccatattgaccagcctggtctcaaactcctggcctcaagtgatccacctgcctcggcctcccaaagtcctgggattataggcatgagccaccatgcccagccaattatttttaaaagaaaatatatttcactaccatgaaaggaaaacaaatatcacttgccataaagagaaggtaaactaaaaatgagaaacaaaacaacgttagaaaattctagccagatacggtattgatgcctactaatagaagtgtgacgagtctggggcacatcacaaaatagatgacatcgtcaaatggggaagtggaggagagtttaatggagaaactattaacaatgatgtgggcaaagttaaggaaaataaaaaaaatagctggtaacattagagggcaattatccacgaggccaggtttaccagatttagtaaataaagacacaggatgtccagtgacatttgaatttcagaaaacaataaagttttttttagtataattatgtctcttgcaatgtatggtacctatttataccaaaagtgatttgtcattgatctaaaattcaaattttaccggatattctgtatttttctggcaacactaccctaggcatgagagtataggaatgagggtggttattggaacacacagggtcggtgatatttggaagtgaagggcgacctagtgggagttacaacctgccttacaggaacaaagccaaatgggacagggaatgagctggagaaataaggattctgagcttgctctcctcttcctgtcttccaattgtctgctggtatctctgattattaggacaatccagaaactagaggccagatcagcctgttgacctgctccaatggtttccatggagataggtcttccagggcattgaggagggcatggaaaaaggaagagcatggatctagaaggcaaacagaaagatacctaggatgcctcctggggatttgagcctgaagtccaatccttactgttcaaagagtagatgagcaaatgtcagaaaagtgtcagaatatttgctagcactcaacttgagactttttcacttggagcaaaggtgaaaaagaatggggaaagaaaaaggaaagataactttctcatgaagtgccccatgttatgtaacatcacggcaaggtagcacctaaaattatgtgtgaacttctaattttatgtgtcccacactttgggaaacctgctaagataaaaggctcaaggggcaagagtagggtcaggagagtgaggcactcacctcagatgcaaaatttcagggggcatcaaaaaccttagcaatcaagataagtaacggtctaaatgtgttatttctaaaaaatcaaaattgatgcaaaaaatccatgataaatgaaatatcaatattttcaatcaagataggccccgtgcccgcattgcacaactcagcctcacttgtcttctgaatctgggttctgctactttaggtgtgtctggcgcttggtgggtttgtcagtaacaaacttgtcacatatggtgggtacgccttaattcccaagatattattagcagctatttaccttatttgaagttcccaacaacacacgagggagtcaggaataggaaagtaactcctgtcatacagtcctagtgtgtcccaaccattcatgtacccgtgaccctttctcagtcttgggaaatgttctcaacacccaaccatgaactgattgcttctagcctaatgattttaagtcagagacagctgggttgaaaccctgtttctgcttcttagaaaagcacaaccttgggcaatttgcaaatgtaccctcgtgaacttccaggcctctatctgcccccactgcctcctgaactcccctccattgaagagccagctctgtacccaccgaaaggtcatttagaacttgggaggagaaagtctcttttagattcttcattttctactaagctcatttgtgctcattcacgatggttgacttatttcctttcttgtctatgaaagaagccaagaggagacatgctgaaggccaaaataatacttttccaacacatgcacagagaagcaaagaaaaaagggaagagaaaagcaaattttcagagacaagcaaagacaaaacaccgcattgtcccagagagactgaaaaaatggcagtctgggttgcagacgtcttccctgttctgctctcctgtctgcccttggcttccttccaaacaccacctcacttttcccttaagttcattgtgaaaggttttcttttacttttaatcaaagacagtaataaaaaagaggttgggcacagtggctcatgcctataatcccagaactttgggaggccgaggcgcatagaatacttgaggtgaggagttcaagaccagcctggccaacatgatgaaacccatctctactaaaaatacaaaaatacaagaattagccaggtgtgttggtgggtgcctgtaatcccagctactcaggaggctgatgcaagagaattgcttgaacccaggaggcggaggttgcagtgagccgagatcctgccactgcactccagcctgggtgagagagaaagactgcctcaaaaaaaaaaaaaaaaaaagaaagaaagaaagaaagaaaaagctactttgatagtcaattgaattgatttaccttatatctcttcttgaagttctcattgctgcttctcctgtttagagtgaatttccgactctaccaagcaaaaagtgaaattgagttgtgtcattcacaaaacatgacaaataaatatccatgactgcttcatccgattgttcaaaaatattcctggacacttgcagatttccttatatagactttaaagcacataatactttgtacttctgtgtacttcctgagtttcctgagtttgaacggaaggaacaaaacatgccagagtatattttttaacactctgaaggagtgtgatttctgtgaccatgaactcattatgggttccattactttgagaagtgctattctttggaaaagatgaattggggagtttggagtcggacatagggtacaaactccagtgctgcctcttatatgctgtgtggtcttggacaagaagcttagtctctgaggatcttagagtcaaaacttataaagttggaataatatcttctcagcagtagttttgtaagaatcaaataagatagtacctaggaaggaggaatgaatctaacttcaatacacaggatacaagaaatgttgcatttgtttccctgaataaaatttaatctgctaacagtcttctgcatctcagcgataaacaaatacacaaatatataaaggaatagtctatgccgatcttcccaattccattgggatggcaggaaatacaataatggatctccctccaacttgtgaaggcactagaagtcttcccaagagcagaacttctgttcaggaggctcttggttcttactcatgtggctccttgaaggaggatttctctgttgtttccatgcacagcttgagtgcaggtgctttgtgaggctgagggtcctggtacctggggctctgcctccttatgagcgtcctccccacagccactttcctctggtatctgtctcctccctggtgcactgtgaaacagtgagaagtgtgtcccaaccattcatgtacccgtgaccctttctcagtcttgggaaatgttctcaacacccaaccaggaactggttgcttctgcatcccaatatgccaaccccagagccctctccttcccttgaggacatgttcaactctatgcaaatgtgcaggctggcgatgataatctcacaggccatcgatgtgttttattctattttttaaaaagaatttttaatagttgtcaagagttaaaaactgggtggaaataaacttcagtacatacacacaatggattactaggcagctgttaaagaaataaggaagatttggccaggtgcggtggctcacagctgtagtcccagcactttgagaggccgaggctggtggatcatctgaggtcaggggtttgagaccagcctggccaacatggtgaaaccccgtctctactaaaaatacaaaaattagctgggtatggtggtgggtgcctgtaatcccagccacacgggaaactgaggaaggagaatcacttgaacccaggaggcggaggttggagtgagccgaaatcgcaccactgcactccagcctgggtgacaagagcaagactctgtctaaaaaaaaaaaaaaagaaaagaaaaaggaaaaaagaaagaaagaaggaggatttgtataaaatgattatagagtgatttctaggagatagtgtcaggttaaaaataaagcaaagtgcaaaaaggaatatatagaatctaccttttgtgttagaagacgaaaaaaagacaaaatgcgtatacattcacacatctttccaaaaagaaacacaaaggaaaagccagaaaactatgaagttggctaccttcaagagctggctaggaggaacaagatggagtgggtacagaagggaggaatacttctcggagtatatcctttatatagttttgacttctggaagcatgttaatgctccacctgttcagaaaataaactaaaataaaccaggatgagaagagatgagtggtaaaatctattggtaacttagcgtcagtcagtcacttacacactggggatcaatgtgaaacaagactcgacatgtgtcaaacaatcctatactttgggtttgagatgtacattccaactcagaccaagcccagagccaatggctcccctatttctttggtctctcccagcaactgattagagataggccctttcatctaagtgtttaacgttatgccttagtattgcctattttgcagttagaaagttaaaagctattttctccctttggacattctctctactccctcctccactgcccttggtacctttaatcctttagattaccccactcttggaggaaggttgacccacttctcatttgttaattcattgaatttcttctgggtgggccactgggaacggggatgcaggttcaccttggaccctgccagtgaagcatttacaaggcggccagattgtccagtgccaagtataacgctccctctgtgctgtcccagaagagcctgcctctttcttcaccctgtgtcctattactagatgctattatcctaggctcagtacactctctgttctaggaagaggagcaagggcagaaataatccttctccaaaggttaatatttgttgggtattcaaaataagatagactataaactcttgtgggttttttccccctaaaaggcagccttggcctctcaaagccaatttgaagcaagaactctgggaaatcaaaagcaggggtaaaggggcttctctggaagatcatttgggaactgggtgacagctggtgtggtgaaaataatacgggttttggaacaagcccacctgggttgaattcagcttttctattctcaagctgtatataatccctttacctctcagcttcttataaataagggtaaaatgaagataaaaggatttatacttcacaggatattgtgtccattcatgagatgtatattaaacatggcaaaccacacaactattcacttattaaaaattatgtcttgcttttctcatcgataaagctggaaaggaagaactatgctggatatttttccccttaaaacatggtcattaaaaaatgtctgattataaaagccatgtatgttaactgtagaaaaattagaaaatatagcaatgcaaaaataaaataaaaatttcaggacacccataaaacatcaaccagagataatcaccatgaagacactgatctttccaaatcttaatactcaatacatatgcatatgtacatacctcaaaggtaagatatattattttacttatattatttttatcatattatttggggtgcgttttaaacctgatcaaaataggcttccatgaataatattttcaaagatcccacagttttcaattgtatggatataaaaaataaatctgttatcttgactcccgttatcagaagtttagatttccaggtttggagtatttcaattactgctgcaatagaaatacttagagctgaaatatttgcacatatatttaattgtttactaagaatatctttactaaaaagggtccaaagttttatcttgttaaggcttttgtctcatatacccaaatcactctctcacatgtttgtaccactttacacttccaaaaatactccacgcaggtcccttaccccacaggtagaaccaaactgaattgtagcattcaaagacacacaaacacactctcacacaattttgcaatctgctggcaacagcagaaaggtcagcacttaaagtttcatttattgaagtttattttttcagacacttcttgctcaccaactggaacattcttaaattgctgccctgtcttgggccttttctaggaatgatgatggtcttctcaactgagctgtgtctatctcaaaatgactttcacttctgagcatatgccttcccatgaaatccccagttaatacccagatgcccaaaaatacagatgggaaaaaatttcaagtagattatgcagtccatctgttccaatattcttcttatgggaataatttcattttgtgtataatcagagaaaagttggtaagataaatttacctgggaccccatagttttttattaaaaataataaaatcttcatctcccctcaagaagctctagtgtgttaaccaaggtcaggaagagcagctgctcaggaggttgtggttaacttccttggagttttatttccagagcaagtgtcgtagaaaaccagattgtctttgaatattcccttagtaccttttcttctgtagaatctttggtattcttttaaataccctggtctttcttagttttatacccatgagttctttcttcatagcagaagttcccagggcttcaatataccttttattgatttcctttctcctaccaagtagaattattttctgttctattccaaaaattgccttctcttctggttcctattaactcaatgcccccaatctattcatgtttgggagctgaagactcaatataaactgtttccttccctttcttgccagctcattccccttctttacacatacacattcaagacctattcttatccattaagaaatgtgtaggcataggctgggcaaggtgctcacgcctgtaatcccagcactttgaggggccaaagagggaggattgcttgagaccaccctgggcaacgtagtgagaccctgtctctactttttttttttttttttttttgagagggagtcgctctgtcgcccaggctggagtgcagtggcacaatctcggctcactgcaagctccgcctcacggcttcacgccattttcctgcctcagcctcctaagcagctgggactacaggcacccaccaccatgcccggctatttttttttaatatatatatatattttattatacttcaagttctagggtacatgtgcacaaccacgcacacgtatgtttatcgcggcactactcacaatagcaaagacttggaaccaacccaaatgtccaacaatgatagactggactaagaaaatgtggcacatatacaccatggaatactatgcagccataaaaaatgatgagttcatgttctttttttttttttttttttgtatttttagtacagacagggtttcaccatgttagccaggatggtctcgatctcctgaccttgtgatctgcctgcctcggcctcccaaagtgctgggattacaggcatgagccaccgcgcctggccaattttttttttttaattagccaggtgtggttgtgtatgcctgcagtcctagctcctcaggaggctgaggtgggaggatcacttgagcttgggagatccaagctccagtgagctgagatcacaccactgcactccatcctaggtgacagagcaagaccctgtctctaaagaaaaaaaaaaatgtatagacataacttctgccttctaggacaagacatggtcacaggcacacagagagaagattctactgtccttatgtacttagcacttctcatttccctatatttgaactgttaaaatttttttatttgaacatttcagtaatcttttaggacctgtccaccaagcttttcttttgcctctttaattgtgcacactaacaagaaagacactttagtagacattagtcacattttttggctgcctagcaatggaacctctttaccgtgtctggggtatgccacaccttgagtcccagaggtaggaaggcccacatcccattctaatatggatgacatgaggcattggctttgccagcctctcccaagtttggatacaggcttatggttcaagttctactgcagattcacaaccaacttcatggttgaggttttagtagcaacgtggcaatgaagcagcaatggtaccccgtttggtggtggcggtggttgcacaaacaaaagtgtctcctgttagcagaaatggtaaaagcaacatccttaccagacaggcatgatttcagctggggtcctagctgtttctcaacctccattgttccagcaggcatccaaagcagacttcccagtcatctgtgagctacccaacattctttcaattgatccctttccttaatatgttaaatcagtttcaagtaagaaccttcactggtgcaaaaaaaaaaaaaattaataccaaaggaagcacttatgtcaagtgaagagcaaatgagctccaggattgactttttgcagcagctgaaagatagaaaagtgggagggagtgtagttattacagaatattacaggcagggtagagtctacagaacctgccccctagtagtcggtaccatacttgtgttgcaaactttgattttgtttgaccaaacaccaccatgcctcacattgcgttattgttattttcacctgtattgctttttactgctttacaaatgtagtgtgtaagcacgccctgctttttagagttatttataagagccataagcatgaggatattacagctggcttacactcatacaagttgtatgatgataattacaatttaaatcaatgtgttacaaacagcaggtgccatcacttctccacccatagccctgtctctcaactctctactgctaaagatgctcactgtgaatatctgctacttcttgcctgagggcttttgctatgggagcctggttggcctgaaagtagagcaagccagaggttctgaaaagttaattcctgtgaaagcagccctcaacccatgaaagaaggggaattattggtgcataaatatcccagcttcaccagtggctatgtagaataactcaaaatacacattttcccaccatcttccagaattccccagtggggatgagccccagatgcctacttgcttgaaaatgcacccttttcctgtttcttttcattccttttctaacttttttactccactaccagtgcctcctgggatcctctcctacttggcctcaaatccgagttgcagggttcctaatcttggtttatcctaaactaagacacttgcacatcaggcatcattgcaccttcactggtaaagtgaatctttacatgttgcattgcaagtatgttaggggattggcagaattgcctgaatttgctctcacacctaccatacaagtgaattgatttcccagcctaacaaactaagggtataagagcaattgctacccagaaaaggggcggatatagcatggtttggtgcagttcctctgggccccaaagcccctaacaggagcatagacgcagatggcactctccacatagggtttcatttttctgcagctgttacatcctcaagcttgtatcatgatcccagaagaacttaccataacaattgacatgctgctattaaagtaaatgttgcaaacaccttgtttcgtggttgttgaatgaaatgcagcatcattaaaggccatatctcctcttggagagggatagggggatagggtcagcacccaaacatcactaaacaacattctgtctctacctctctaggatcacagaaaggaagccctttcgccctagaaatgtacctgcttgagaagctctgcagtgtgttgaggaaagaagcaatgataccatgtgagggaagtacaatagactagaagttgtgtcccccactccaaatttatatgaaatcttcatccccaaggtgatggtatcaggaggtggtgcctttgggagatgattaggtcaagaggtcagagctctcttgagtgggattagtgcccttataaaagaggcctgaaggccgggcgtggtggctcatgcctgtaatctcagcactctgggaggccaaggcagacggatcatctgaggtcgggagttcgagaccagcctggccaacatggtgaaaacccatctctactaaaaatacaaaaattagctgggcgtggtgtcatgcgcctgtaatcccagctactcaggaggctgacgcaggagaatcgcttcaatcccgtaggcagaggtttcactgagcctagatcgatcgcgccactgcactccaacctgggtgacagagtgatactccgtctcaaaaaactaaactaaaataaataaataaaaaaaagaggactgagggagatcccctcgccccttccaccatgtaaggacacagctggaaggcaccattctatgaaccaggtaacagatcctcaccagacatcaaaactgctggtacctgaatcttgaacttcagcctccagaactgtgacaaataaatctctgttgttcataagccactctgttcatggtgttttgtgatagcagcccacacggagtgagcgagcagcctgggtgactcacactgcctggggatgggcattagcagtaacgtcctgggtgtatgtattggagactccagtctttagtacctgcatgtacaggtagtctgtgttcccccccatcactgattctcctgatccaagtgtcactccgtccccccatgcacctcatcttcctgcctgctcagttccactgtggaaatgattgagttaaatccttaagataaaaaataaactttgctcacaatgaccaactagataaacaggcacatgcaatgccaaaactcaaaatcaatatctgggagactgtctctatttggaaaaggagaggtgtattaaattaaagtgtgtcctttgatttttccctcaacaaaatatggcagtctctaaaacaaaattgcccagaatgatttagtagccttctaacatcagcttcaaatgtattcaagtgtctgcaatgagacctgcatgaaacagacctctgagctcatccaaaggacaaacagtattccaggttgggaacattcccctggtgtgtattgtcacatcaatagctatcatttccgatcaatgtcatttctgcaaagagagcccttgtgtgccaggccactgccaatagagaggactaatgtgacctcagcctctgggctggaaagtcccttgagcatcaattagtccaaggaccttcttttaccaaccaaaacaaggacatttccaaagtcacacaggcagcaagtcaaaaccacaggctaccttgctcccagaaaccaaggatccatggcttacaacagggtggttcaggccgggtgcagtggctcatgtctgtaatcccagctctttgggaggctgaggcgggtggatcatttcaggtcaggagtttgaaacaggcctggccaacatgatgaaaccccgcctctactaaaaatacaaaaattagccaggcgtggtggtggacgcctgtaatccccgctacttgggagaatgaggtaggagaattgcttgagcccagaaggcggagattgcaatgagcagagatcgcgccactgcactccagcctgggcaacagagcaagactccatctcacaaaaataaataaataaaaattaaaaaataaaataaattttaaaaaaaggccggacacggtggctcacacctgtaatcccagcactttgggaggctgaggtgggcagataatgaggtcaggacttcgagaccagcctggccaatatagtgaaaccctgtctctaccacacctgtagtcccagctactcaggaggctgaggcaggagaatcgcttgaacctggaaggcagaggttgcagcaagccgagatcaatcatgccactgcacaccagcctgggcaacggtgcaagattctgtctcaaaaaaaaaaaaaaaagaacagggtggttcaactttggcactattaacattttaggctggctcattctttgttttagggctatcttgtgccttgcaggatgcttagcagcatctatggcctgtacccatcagatgcttgtagcactactggtaacaatcaaaaatgtcttcagacactgccagtgtcccccaaggcgtaaaatcacctctgacttagagaaaacattgcacattggagccatatgggctaaatttggctcacagacatgttttgtttagcctatgtaatatttgtcaaaattttataaatttggtatatttcacataatgattcagacttttggcctctcagaaacacctggaagccccagcaaccctgagctcacattttcacattacaatgatggatcaaagttgagttttttgtttgtttgttttttgagacagagtcttgctctgtcgccccggctggagtgcagtagtgtgatcatggttcaccgtagcctcaacatcccaggttcaagcaattctcctgctgcagcctcccctcctgagtagctgggactgcaggcacatgccaccatgcccagctaatgttcgcatttttttgtagatacaggatctcactatgttgcccaggctggtctcaaacacttgggctcaagtgatccacctgtcttggcctcccaaagtgctgggattacaggcttaagccaccatgcccagtcactatctcttttagaatgccctctgcactccggtttctcacagtccccaccactctctgttatgtcccacaacaggcccacttcatttgcttcataatgttctcgggcctggatttaaagttttcttaaaacaatttgtggtatattttatcttaagtaagcccctcagttccttgaggtcagagtcatgttatttttttcttttgttccttctacaatgcctaaccttgagcagacacttagaaatagttatccatttatttacctatagcagttttccccaaaagatatcctgcagaatgctaatcttgttaacttcaagggcaaagggctggaagtctaataagtctcagtaaagctgtattctgaatccctatgtagagattcaagagttatgctaagactctaaatctacattaaagaaagctgcttaactgtatttgacccagagtgtctcaggctaatttgaccacagaccctccttttaccctggcatccatcaacatttaggaaaccactgtttcgttgaatagactttggaaaccacttaactaaactctaaccatttcaaattagacacaggtgtttaatattaagcgctatgacaaaggcagttacaaagtactaacatgtaaagagtttttttctaagcatagacatttatttcaatcagctgttttaaatttctccacatatttgtgaagacaatgtgatcaatgtctacacctcacagattagaaaatgaagcaacaggccgggcacagtggctcacatccataatctcaatactttggggggctgaggagggtggatctcgaggtcaggagttggagatcagcctggctaagatgatgaaaccctgtctctactaaaaatacaaaaattagccaggtgtggtggcgggtgcctgtaatcccagctactcgggaggctgaggtgggaaaatcgcctgaactcgggaggtggaagttgcagtgagccaatatctcaccacggcactccagcctgagcgacagagaaatattccgtctcaaaaaaaaaaaaaaaaaagaatgaagcaacggaaagattaaggaacttgttcatggttacatagctaggaaaaggtcaagccaggaacaaagcctgtccgatcccaagacatatgcacgtagcctctctttacattgtcttgcctccctgaaacgttgcaccatgttctctatgtgtctgcctccccactcaagacaggtgccaggccttattcatgaaggaagtagccaggaaattattgtccattgatcaactgttatgcatgggaaataatacttggaagagtttggcatggtatctcatgcagaattagatattctaatactcatttattgggcaattctcttaacctttcagagcctaaaattcacataggtaggaaatgggaaaactgggttctgaacaagtcctggaaacaaggtatgtgttccttctaccttccttagtgcatatcaagaatgcagaattgggccaggcatggtggctcacgcctgtaatcccagcattttgggaggccgaggtgggcagatcacctgaagttaggagttcaataccagcctgaccaacatgatgaaacactgtctctactaaaaatacaaaaatcagctgggcatggtggcaggtgccagtaatcccaactactcgagaggctgaggcaggggaaccacttgaacttgggagacggaggttgcagtgagctgagatcgtgccactgaactccagtctgggcgacagagcaagactctgtctcaaaaaacaaacaaacaaaaataaaacaaaacaacaacaaaaaaataatgtagaattggatgaatgagtggatagatggatgattggacaattgggtgatggatggacttcttcccatttgctttgtggaaagtaccccattaggctctgtgaagagaaggggcatactaaaaggaataggacaggatttctgaagaacatttccccatttcctgggatttaagcctgctaccctcagaacaggaaaggcaaaatgtgcccttttcatggtgtgcattttcagttacattgaggtcttgtagcttcacagtcattactgcaaggaagccccaaccaactggatataggccaatccaacaataaaaggaacaaaactttcagggacatcagctcttagcctcaaccagagacatcagggcaacaagagagtgaattagctggagggctggttcatccttatttatagtatgatgatctcagcttgtaaggtggaaaaaacggtgcaggggaggaattcgtcccctttctggtttctgttggaccctatttgaggagtaaatgctttgtttatttctgaacctgaattttacgtccccatcccattactcatcatgatctatagcaaagtactttagggaaaacacagctctctgcagtgcttggaagaggcaggcagcattactgtgtggtgattcatacaagaaaacacacaggggccggacacagtggctcacgcctgtgatcccagcactttgggaggccaaggtgggcggatcacctgaagtcaggagttcgagacgaacctggccaacatggtgaaaccacgtttccactaaaaatacaaaaattagccaggtgtggtggtgcatgcctgtagtcccagctactcaggaggctgatttaggagaatcatttgaacctgggaagtggaggttgcagtgagtcaagattctgccactgcaccacagcctggggtgacagagccagactccatctcaaaaagaagagggagggggagggggaggaggcgaagaagaagaaggaggaggaggagcaggaggaggaggaggaggagaaatggaagaggaagaggaagaaaagaaaaagagaaaaaaatcatacagcatcacactagggggaggaccctagataatattcaaggggaggggtacaagaaatcactcagaaattatctttcagtgtgagtgaaatttcaaaaacaaactacatgatttaaattccttagtcctatgttgtatattttcctctttacttgaccaaccatgtttaccaaatgatactaaacaattgataagatcatctccacatggataacagctgcttatggagatgagtaagagcaggtgaaatgtttctatttctattcatacatgagcagattaatagagagctaaaatggtgttcagggtcttatgagtagcacttttggttagggttttcctgttaacatccattataaaattgcagctggatccctatggagagaaaactccaacagggtgaaaatgtatcttacagaggagttgtgagagggaagcattgaatcccagggactgggattcttgggtaatgttttgttgtagggaggccatggggactcctcaatactccacacagactatcattcatttatttaaagcccttcagtggcatctgtggaagatactgctacacctcctaatgctatctgtccctttcctcattaattgtagaaccttagcttttacttggacattgttacttagctaagaaaaaactaggtttcccagcatcctttgcagtgggatgtggccatgtgactaggctctggctaatatgagataagtacatgtattatggtggagtcctgaagtgcccttaagatgaaagctgtgggtctttcttcccctctcacgcatctctgtcctgtcacccagcacataaatgtgatggctatatcttaaactatgagaatggaggccagtgattcatgacctggagtacagagcaggaaggaacactgatccttgatgataatgtacagcctccatcccatcctaatgtattttatattctttaagccaatttttattttattattatattttgttgtctgtagctgaacctaatacattaccattgctttcatagagaagcttttaccgaccatgcagatagccccttgtatttcccctttacagcacttattgaactggtaaatgactaattacttacatgatttttttttttttggtttaatatatgtagcagagatggtcagtgcccaacctaccccctcttggatctcatcactgccatgcacagcgaccccatggcttccaagtacaaacacctgcaactctttcaggacagctttgtctggctgcctattcccaaacagcccatgtgcatggcaggctagaagtggcagatggctagtgccccacagaaacagtcctcaactaaggactaacaggagctggtggattctccattttctttgcctcttgatggggatacatctgagatgtgctctacgctgtctcctagagttccccagcaggatttaagcaggttatagcagtgataacctgctaagtaatacacctcatattggcttctttcctaccctgtctcaccttcacagacctcttccagtgcttcctgggatcacttctcaagccgtatgtatgcaaatcttcaaattaacaaacgtttgctcctgggcaacccaatatatacctcctcaacagggctgataactccattaggactgagaatatatttgtcttattcaccatgttatctccagcatttagcaacagcacaaggtcaccactcaaaaggtgataagtatcagtgcactttttttcccctcagacacaactagagtttaccatgtaagacccgtcctacaaagtgtagacaggaagtgtatactgccaccatcaggatgggctgcacacttctctagcacttctctgaaaaataatgttgtgctcattgggaattaaccacaaactataagaaattatggcacaaatcctctaatataactccctggattttgttaggatatttcaacagccagaatcttttacctctctccattattgacctcctaaatttgtctcctttttcttaacctatttgatggcattcttgtgagtaaaagagcaacaaataaaaccataagcattgaagtgtggtggttaagaacatacatttcaaagtcaaatagctcccatttcaaatctcaactctgcaatttgtttaggaagtaattctgggaaagttactcagtttatattaaattttctcctctgtaaagtagggataatagtcctatagcataggattattttaaagatgaaatatgtacaacaaatgattctaattgtattgaagagaatacaatgcaacaaatattattaaagcatatagttaaagacattgaccctcttccttaaataacatttctctgggaagttactgaaccattccaaataatttagaaaacgatttctaaaagtgtactgtgtccagaattagtgggttcttggtctcactgacttctagaatgaagccgcggagccttgcggtcagtgttacagctcttaaggtgacgcgtctagagtttgttccttctgatgttcggatgtcttcggagtttctttcttctggtgggttcgtggtctcactggctcagaagtgaacccgtgaaccttcgcggtaagtgttaccgctcttaaggcagcgcgtctggagttgttcgtccctcccggtgagttcatggtctcgctggcttcaagagtgaagctgcagacctttgcggtgagtgttacagctcataaaggcagtgtggacccaaagagtgagcagcggcaggatttcttgcaaagaattaaagaacaatgcttctacagtgtggaaggtgaccccagcgggttgccactgctggctcaggcagcctgcttttattgtcttatctggccccacccacatcctgctgattggtagagcccagtggtctgtttggacagggcgctgattggtgcgtttacaatccctgagctagacacaaaggttctccacgtccccactaggttagctagatacagagtgtcgacacaaaggttctccaagtccccaccagagtagctagatacagagtgtccatttgtgcattcacaaaccctgagctagacacagggtgctgattggtgtgtttaccaaccttgagctagatacggagtgatgattggtgtatttacaatccctgagctagacataaaggttctccaagtccccaccagactcaggagcccagctggcttcacctagtggatcccgcatgggggctgcaggtggagctgcctgccagtcccttgccgtgcgcccgcactcctcagcccttcggtggtcaatgggactgggcgccgtggagcagggggtggcgctcgtcggggtggctcaggctgcacaggagcccatggagcggcgaggggaggctcaggcatggcgggctgcaggtcccaagccctgccccgcgggaaggcagctaaggccccgggagggcagcgacagtgggccggcagtgctgggggacccagcacaccctccgcagccgctggccctggtgctaagctcctcattgccgggggccgacagggccggccggccgctccgagtgagggcccgccaagcccacgcccaccaggaactccagctggcccgcaagcactgcacgcagccccggttgccgctcgggcctctccctcctcatctccccgcaagctgagggagccggctccggcctcggccagcccaggaaggggctcccacagtgtagcagcgggctgaagggctcctcaagcgcggccagagtgggcgccaaggccaaggaggccccgagagtgagcgagggctgtgagggctgccagtatgctgtcacctctcagtactgatggtttcccatattttcttactcagagactttacctctattaggggttcctatatctggccttctacatccccccccaccccccacacacacccccacgtgcacataccctgccccagaccatttgcaaggtaacagagctgagctgtaatactctgttttaccatcagtggccactgtttgacattatgtacaatgatgtacataatgcacattattctacaataatgtaagaaattccacaacggaggctctgagtgaatgtccaaggaatcaattttacaaattaaaaattgatttattgtgtttatttggagatatgccatgcactgtggctctttccacgttccaccagggagtaccagagttgggaatatttaacaatagtggtatataggactcagaagagggtatctccccacccccccacaagcagcacagactgtggtgggttctctctgggttgttgtgataatcagctgcctaccaattataatctggggtttgtaaacagccagaagattcccttggagggagtaattatattccctttaacacactgtaagacaaacactttctctttaacatgctgtgtgctgactacaaagtgggtttactttactaatgccaaaggaaaacaaacactcagaaccaaggcaagggaccttggtggtacagagatagtaggcggtgaaaaaaaagagcagggaacattaaaaaatgccatggagtattgtcaatcaggggcagaactggtttggcctgtccgtataaacatgcatgatgagatcttaagagcacagatttggagttggtcttctatctcattataactagcatgttcctttgagcacaataattcatcatgttaagattcattttcattttcctcttccataaagtgggaataggaattcttactcatgagattattttcagaatcaaattaagaaatatacctacagtgtctagaacagtagacacctccaaaacaataacatatattgcagatattattggtgccaaagctatgtctccatggaattcatcattccatgtataaaatgatagcttcctgcaaagagcatccacaattctctgcctggggattctctcagcccaagtacatgggacaggatggaaatgtcaaggagttaacaattccaggaacagttcttgaccaatcaagcatagactttagtgaataaatacctatgtcctcactccttgggtgagacaactctgagacttgttctacactgtctctcaaatgtcccctgcgggtttgagctccaattgtccactgcggtaatctgcttattaatacatctcatattgggtagtatcaattttctgtctcactttcctacttcccagccagagcttcctgggattacttccaaaataaacgacgggtgttcaaattcttgtttcaggacagaatccagcctaaacactgtatctcacaatgtaaacaagacaaacaatttggacaattggattcacaataaaatgttcaattcactaaccaagccctattcaggcttcttttagccctcttccttccatcccatggccattgcctcagttgggaccattctcatttattttgtttctttttggggatttttttttttttttgcctgcacttagtctctaactgatctcgatgcttccagtaactctatcatctaatccatcacccacttactgtcaaagttattatcctaaaatgcagttctggtaatgctctccccatgtttttgttttttaagcctttatggcaccaattgcctctgtgattatgtcttaaattttataacctggtatgtgagaactttcaaaagctggtcccaataaacctttcagcctcatctccaatgattgctaaatacagccaatgttctgcctacatagaacaaaccagaatctcaaaagcccttttacctgttacctttctgtgttatttgaatgagcttgcgaccttttctgccagaagaacctgccttatccttcaaggtctagcccaaatgttccctcctccatgagaacttctccaactctctggaccagtttttcaacaggctgcctctgtgcatattctactatgtaccaatcatgtattaagccctgggaaaaccacgctggataaaagtagaaatagctcctgctcacatgaagttcacagttggataaaggaaacagatattatcaggtaaacatataaaagttggctacaaagggacataagtgtctatagtcagggaggacaccaatctggaggttggagtgcctcccaacaggaatggacccttgaggtgagaacgaagtaggagttaacaccagataaaggagatggaacacataccccaggccaaggggacagcaggtgcagaaccctgtggaaggagggaaaatggcaatcgtcttttttttttttttttttttttttaaggaatagaagacaagggcatttaaagcagtgaggcacaggaagaatgaggggagagaagaggcagcacttacatcattcattgtaccacatttgttgactgtgtccttcatgcctcatgctctgaaattgaccttttccaatataaggaccatgtctcactgaaatcatgtccaccccagcacttcacacaatatagaaaaaaaaatcaatgtacccaatttatagatgagtgtgttgaggctcaggaaggttgaatgagttgcccaagatctcaaggctggcaatggcatagcaactataatagaatatagacctacttcctcacctgcatctctttccttaaactgcccctaggaaaaccacgtccttccccattattttatttcagaaattccaagtttttctatgagctgtttttctcaaagagcctgataacaaaacaaaacgccagttactactctgtgtatgtgcatgcatgttggggagcgggtacacactggtcttccggggatcagaacacgaacaggatcctttctggtacaggattcttgtctgaagcctctttaatagcccgaaatggtgtgggtggtgagaattcgccgtcgtaaggaagcccctggtgatacccagcaaagagcatcccggctgaccctgcaggtctggagtgaaaagaccctgcactggactcttcagggcagtgagcgggatctctagttccctgcttcccaaacctctccgcccttccacccaaaactggctgtttgagaaacgacccaatttcccgactatcccgcccagcctcgaagatgggagggagagagggcaaccttgtcgcggtaaggcatcctccaggcccagacattagtctcggtccatttcaaggcacccgagcctgtgccgtatataaccaagtactgggcccacaggaagggggatgacagggtggtctctctaggctcgttttagtcacagatcttcggcaaatttgggtttagggccgcgatcccgaccctaacttgggactatttcaggaactggagttgaggcttcgttgggacaggaaagaagggtggggcgggggtgaagcgcttagggcacggctcttgtgaggattacggcggaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctggtccagtatccgcgcctttctcgctttctctctttttgcgcgctgggcgctggggagggggtgggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtctgagaggacaactcagctttcgcacgggagggttgatgcttaacagaattaaaaatatatgtattaagaaccgcaagcccactgtgtgccagccgccgttggtagttttacacgtgcgatcttatttaatacttcctgggacctaatgagtcaggtgccatcatgatccgtttacaggtaagaaagccgccgctcagcgagaatgagtgatttgcccaagatcagtcagctgccactaagtggcttggccgggaatttgatacatgatcttttttcacctctatgctgttgtcctgaagggcctgggacagggtgcagggctggatcccgcctcctgcccacttccttccccgtagcctgacggggaaaggaactaggaaggaagagggtcggtaccttgcacccaggcttggtgagggtggagaccagggctgcagcgcaaccccctccatgcccctctccatcctctgtttctccgagaggggaaaaaaccctgatcagtctccccggaattcctggtcccatctcagaaggagctcagctctctaagctgccctctattccccattccccctgggggaacttctccaggccctcacgctcagctgaaattcccggggagagtttaagcctctctgtgtgcgggcactgtaatttccctgaagttctgggaagagcttacccagcagaggcggactggacccaacactaggtttgcatgttaaacttgtaaggggaacttgctattaatcacggtgagacgagcctattccttcccatctgttttctagagccccccagtacatactgctctccaaagcagcagccagctcacgagcttctaggttagatcagaaacccaatatctggacctctctagaggcacgagaaatacaaacgagggtcccctcccgttcaccaccttgagaacagacgcaggtttcatcggccagattagaaagcagctagtgggagaagcagccgctgatccctgccttgctgctcatatatgcagctggtcaggtttgactctgaacacgactcgtgagtctctgtggggaattccgggtaagggaagaggcttttgcaaaccgggggatcctgtacaataaactcttattgaaccaagttgtttgatcccagaaggagagcttatatctgccctttcgcagctaaatccccaaagaccagcccactcccccaccccacactgtttggcccactgcacatcctaaataagttatcgctgaatgaatggattgaggaaagagctcggaggaggattgttgggtcattatttttctttacttgctggtggaagagcttttgcttagtacaattaaaaccatgcatttagaactctccttccttaaccacttcatcaaaaaaaattacctgtatacacacacctatgcatatatgtgcatatacatatatacaattatatatacagttgcatatgtatgcgtatgtaatttatgacccttcatccaaattgaggatgggattctaggattctagagtacatattcagagagggaaaatgataaaactactttttaaaggaaagagcatcatctgcagtacacatagttctgtgttttccagtcttatgttaactgcataattgctgataggaactgaagcattttgaaataataaatgtcaagatgaaggccaagagattgattttcaaagccagatgtgaaagcctgttcttcagtggcgctacacacacacacacagaaatcactgcacttccccgaccctagttgttcagaaagccaaccaggctgcaggtacatttggaatacagtgttgcaaacagcccagattgattttcctttcaccaagctggaagcagagttaatggttttacaaggaaggattgtaataggcttgtaaatggcccactgggcagctccttctcctctgggctgggattggctggccagacatgatcattgattataagttttagccttgggatacaggatgactcattctgtatttttatgaatcagccgatggcttcctggatgatggtctcccttttatctgctctctatttttaatagaaacctttttgtcataataggatatgctttttgcttggaataaagcatagtccatttgaaccagtattagacagacctggaatgacgttccaagttggctatgaattttatgaaaatggaagagatgaggcaggaagaaatatccattttatatcatggaccctttttcattaatgcgccagtgagatgggtatttttcctacagaacagaagagcaaattgaggcttggaaacattgagtaatttgccaaaaacatcaaaaaatagtagacttaggatttgaatctaattctccttatatttttgctattttccttttattccatttttgtctcccttggtggaaaagccttagcacatgtgattcccctcttagcatgcagtctcactttctttcctttctccaccgaagatggttcctttgctctttttgtgtctggcttaagagaatattctctagctatttccaaagtagtatggctttctccagaaagtagagacattttggtcaaatgcagctcaaaaagaactgttgctggggtcagggttggaatgatagcagagtcttctgtctaaattgttttttaaaatgtcagttttgatggcagatggatttcaccaattattcatggaatactttacgcaacaagaggtttaagtgaccaggtggaaaaagcatgtggcccttgaagagagagggacttgaatataagcttaagcctcatctcttcctatccatatgcccctgggggatgtgtctcagtgtctccaaacttcccatacattatctgcaaagtggggataataaaatgaacttcatggtattgttgaaaggatcagatgcaagaaagacactgccgcgttgtcagcattcaataagtaggattcattgtgactgtcgttgttgccatatctaaaccaatgtgatatatgctgcttggtgacctacaacttggaggccatcattttaatcatgtatataatataggcaatatcatgtcacatctgcttagtgattaagagagcttcctagacatgagtcccagctctgatacttgctaactggatgtcttaggtctggctccttggaggcagaacctgacgcagggatcctttttcaggtggtttattgaaagtgtgcttttagaactatgggagcaagggaagcaggctagggaagaggaaggagttaagcaaagatgtggtcttagctggatcccactgcagagtcagtctcaccttgaagcaaggaacagagggagccttgtgtgtcattggctgtgagctactttctaagtggggacattgagcctctcaagcagaagtggcttctatctgactgagcaaaattctctagggaaagggatgactctgaggcttgagcatccaacacttccagcagtttggggatgggcacctgcccatagacaggatctgggtgaggtacaaaccacgccttctggttggccttggccatgttgttgttaaaaacatgttaacaaacttctgtttcccggactataaaatagagcatccattttataatagcatcccccttcatagtattgtaatgaagcttaaatgacatgccatatacaaagacctttataaggatgcctggtgcttagcaagcagtcaaaaaatgataaccattattatctaaacttttacttttggttgccgtataaactttagtttattattcaaactggaactcttgtattttgagacaggcatagcaagtagtcaaaaaatggtaaccattattatgtaaacttttacttttggttgccatagatacttatatagtttattattcaaactggaactcttatattttgagacagggtcttgctctgtcacgcaaggtgaagtgcagtggtgtgatcatggttcactgccaccttgatctccctggctcaagtgatcctcctgccttgacttcctgcatagctgggaccacaggcatgtgccaccgtgcccagctaatttttttttaatttattttttgtcgagacagagtctatgttgctcaggctggtttcaaacaaactgaacctcttctgaaagcagaaggggcactatttataattactcctacataggagaagctacaatcataaactggaactgtcttaggcaaaccaaggtgtatggttcgcccctaactgatacaagtcagaactgtgcctttgctgctatcagtcttgtcacagttgagtgtctcttagaccggggctgctaggattttaggctggcagagggtctccaggttgggctgcaggaatgtatttaagtggccattaacaaaccttgtctggtttgtggttcaaattggcttgcagtagaagggcactaatggattagggacatttattttcccagaatgatttacaccaagaggctacatgaaactgctggaaagacaccaagtggatgaaaaatggttccagccagtcatggttccattggctgatctgaaaatgggctgagggcaggccacatcagaagaaagctaccagattggtggaattctaatatgtcacgagggtatagtaaattggagatagggaaggaacaaacatgtattgatcagtggttatgagccaggaactgagttggctgcaatacactctttgtttcatttcatcctaatgacaactcaacaaaatcagtattgccatctccagttaaagatgaggaaactgatattcacagacacatcaggatcacagactgctaagtggaagagccatgtgaacacccaagtgtgcctaaaacccaaatggctctttacattttggagaatcagacagacacagtgacaaagacataaaagagaaagagacagagagacacacacacaaatcatgagagatcaagagacacagagaggcagacgggcacacagacaggaatacagagaaagagccatgaatgtatttgactgatttgaaatacaactgctaagattcaaaattgcacagtactatcctgcctcccaccccaaaacggccattatgtttatgcaccacatccatttcatctacacttgtgagatacagtatgtgggatgctttgggggatccatctagatggagttactatgactgttgacccagaacacccatgctgattaaacacaatcacaatcaccactccttgaaccactaaagatattggagttcctccctctgcctcatttaccttgatcaggccattgctacattggcaaaccaagtataagttatccccaaacaacagagcattaaactgtcaccagtaaggttgatgcaatgaaaggtggccaacatgatattccctgtgtttattcaaaataaacaagtggcatccatgaggttaagatgtttgtaaaactaagatgttgctcagagggtttctaatgccaagccaggagccactctgacatggagattggaataatgtgttctgaatcactctgtattggatggaagcatcaggatttgagaggaaaggatgactccatgctgagtcatatttaaggctcatttgatgatgagaaagaacatggaagtgctagctcgggtcatttttatttaatgaaatttgcattctctcatcaactgagtccttgctgatgaggactggggatggtgacaatatccgctctttatccaataatgaaatgggcttcttgcttttctggcgatttgaagaggaaaggaaacctagaatcagtgattcttctatctcatgagaacaaagaaataagttttgaccccatcatttgaacccactgtttatacttagcatcttaccccctgagaatactttgatctatcagtagagaagcctttgtcttttctctccattttgtgtcccctctccctcaatctgtatcttcacatacttctgtcttcccatttttccattctgctgctaaaaaattaatagccaccaaagaataacctcactaatggaagcaataattggtagaatttacagtgggggcggggggaaagattgagaaattaagatttgttttaataatattttacatgaaataggattcatccaagtagaaataatttcagaaaataaaagcgaagtaaatggcaaatagcttaacagcttattaacagcttaataacaaatagctaaaatgtgccatttagaacattttaatttgctaaaaaccaacactgttgtcatacttctgatggcttgtttgtagtaggtatttcctcaggattaaaccttttggggggttgaaactatggaattaaaaataacctgggatcaaaaggaagagcctgaaggaagagcaggaatgaaggtggatgggtcaattcagaaaagattcattcattccaccaagttggtcaactagcattagtagggaatcagcgcagacggggaggaagctgcctatcctttggaaagtgctggggctctggtttcaggcagacatggattaaaattttgctttgccctttattaaccatttgtgtttcagcaagtcgcttagctcccttttttctctttttttttttttttttttttttttcatttgagacagagttttgcactgtcgcccaggctggagtgcagtggcgcaatttcggctcactgcaacctccacctaccaagttcaagcgattctcctgcctcagcctcccaagtagctgggattacaggtgcctgccaccaagcccagctagtttttatatttttagtagagacagggtttcgccatgttggccaggctggtctcgaattcctgacctcaggtgatctgcccgcctcggcctcccaaagtgctgggatttacaggcatgaggcaccacacctggccagttgcttagctctctaagtcttatttgctttacttacaaaatggagatacaaccttatagaacattcgacatatactaggtttccatgaacagcagccagatctcaactatatagggaccagtgagaaaccaatgtcaggtagctgatgatgggcaaagggaatggggactgattattgcacccaccctaccatccatctgcagcatctttgcagtgacaaagcctactatgtacctcagcttttcatctgatcttcaccaccccatggggtaggtgtcactgaaattatcatccatgttttctaggagaggaagctgggactcagggatggagtggaaatagtgagaagctataaccaatttgggttcagatcctaactctacctcactgtggctgtgtgatcttaagcaaatagcactttcaacttatctacttcctcactttgttaatgatatgcacttttacttattgttacaaagactagctaagtgtctgtagcagtcttgacggtgccttgcacatggtggcactcaataaaggttgtttcttcctaaatgacttgggcttttacatacagaactaggacatgaattgccatctcttgttttcttgcctagcgttctcacactaaactacattgccagcacggagtaggatgctggcttttctacaaaatggaatgaaatcatgtcttttgcagcaacatagatggagatgaaggctgtaatccaaagggaaataactcagaaacagaaagtccaatctgggacgttctcacttagaagtgggtacctatggccatggtacacactgagtagaataatagacactggaggctctaaaaggtgtgagggtgggaggaagatgagggttgaaaattgcctaatggtacagtggtcactactggggcagtgggtgcactaaaggcccggatttcaccattacatagtatatccactcaacaaaactgcacttgtacccttaaatctttttttttttttgagatggggtctcgctctatcacccaggctggagtgcaatggcgctatcttggctcactgcaacctgcgcctcccaggttcaagtgattttcctgcctcagcctcctaagtagctgggattacaggcatgcaccaccacacccggctaatttttgtatttttagcagagacagatttcaccatgttggccaggctggtctcaaactcctgacctcaggtgatccgcctgcctcagcctcccaaagtgctgggattacaggcgtgagccaccgcgcccagcaatttttctttttttaggatgctagctttcaaagccacccaacttccagggttgggaatggatttggactgatctattgctgccctcccaccagccccctgcatccccacccatgggttgctgcagggatttctttgctagctgggtgtatatagacaatccagcctctggagctagctttgctagctgggtgtatatagacaatccagtctctggagcactctcattcaaaggagtcaaatcccatgctttggacacatcactgacactcaacactgacagcagagctcacccaggcatgaagaaatagtgccccgatgacctccaagctcctgggacttccttttcctaagagagagccttttggacatcttggcatttgtcacagaagaaaaagtgtaattagaaggaagaagagactcttcacaggaaagggtggcgagcatgtaatctgaaattagtttgattcctctgtgtgtgatctcatacagaaaattggttggagccatggtatgaaaatgagtgaattttatgtctgaaggcccaggagacaaaatagatgttccagtgaaagaagctgttttatctttgaacatgatattttcctgatgagagcatgccgtcagcatctgtcctcagtctcctgtcactgacccctgaggtctcatccccagaattttcctggagccagggacatgctaaacaatgcttcaccaaacagaacccaaagccaaagcattgggtcctctcactcttgacttctctaaataactgtggtccccagagcctaatgcaggataattatcttctgagccagggatgacaatgattcctttcttaacctggcactagccatacacccaagccagatgagaggcagtaggcttcttggttataaagtagttaatgtgtgaactaaaacaagcttgaattcaaatcctagctctaacaattttagcaacctgtataaccttggaaaaatgattaagtcttttgaaacctcagtttgctcatctgtaatatggatggggtaaaagtttttgtgtggggaaagaagaagataatgcagctaaagtgcctagcaaggatgttgatacatttcatatttgttgaatgaatgaataaatgaagtgtgtgtgccatagaagatgtgtttgatagatattaatggtggggaggaggtacaaagaaataggacattaaaaagtccctctgtgcttcataaagttttctgaatggagtccctcattcagactccacctgtatccgccaaagaccacaaaaccctgacatcaaaagtagctcaaacaggatatgccactgtgtcatgacatatacaagaagatcaagaggaattcctgaagggacaagcgaggaaatggaaccaaaatacactgtgcttctactgtgtgctagaaactggaccaagcttagagatcttcagagggcgggaaggccacccccttactccctcccctctctcgttatttcagccctgctggccatcatgatgagtttgtccctgggattctaggctttctcctctccttccccttccatctttcatcctctctcctcataagttagcttcatgtactcctgctgcaatgagcttccttcccgaggctggaaaaggtggtggtcattagctgcagctgccgtgtgaaaatttagcgagccccagtgcaaagagaacttttttctcccagtttttatgtattaaggaaggactttgattggtcctttgcaaatcacataccagcccctggagatctctctccctctcttcctctcccggtcctcctcctcctctccttgtctctccctctctctctccctccctcccctcccctccttcttctctctccctctttctctgtctctctccttcccttcttttccctccgtctttccccttttctccctcccactttctccatctcttttcctctccactgcctccctctctctcctctttctctctctggcttaagaaaatgaggagctgtgattgaccacacctgtgcctcatgctctcttaccttggtctaaaagaaggtaagcatcatgtctgacagccccactggaatacatggtgtgtgtgtgtgtgtgtgtgtgtgtgtgtgtgtgtgtgtgtgtgtgtgtgtggtgtgtattgggggaaaaggagagggtaaatactccaaaaggaatggagagcaattaccagaaagagggggataagaagcacatgagactattttaaatggcagccatcatgagtggatgcgagactcttcttcatccagtaaaaagtgaagaatcggaggggaactggagaagtcaggtccattccctctcctgtgattgtacctttcttaccacagttattaagtcacattaaataacacatattttcaactttgaggcccatcatcttgtagatatttttggtaatcttggaagttctaggaattttctctgtgatcagttaacatgatgccaagcatggtgcttggttcacagtaggcactcaataagtctggagaatgagtaaatatattactgactttctagtaaacatgaccttcctaatacaaacagtggccattcctggtcagtggggctcaagcttcccttcctcatctcagctttctcctacaagaagctaaatctctcctaaggcctctcacatgcagatctgtgagtgagaacctggaagaataccaaactatgttttcataggactatattttcaggagttttacttctccttaacacagtctattctcttggaagaagaaatgaataatgactttccctagcctgggaaatgtgggtctctgagttctcacgatgctctgtaattttctccttgttgatatctggcttcatcgagtgccgcagaccaaagctcttagagagaacctgccatgcaggcccaatgactgttatttcatgagcaatcactcaagcatccctgcaatacatgggattatcaggtatacctggggactctaaggccgaccaacatggatgttaaaatcataaaccctatttccacgactctgtccctacccttcgtaggtatcaggcaccccaaactgcacccttcagtacccacagagagtttcaagggttgcctagaaggtgttgcacaggtactcagaaacacagttctcctggttgcccaaatgatcctgaacctttcctattgccttgttcttttcccactgccatacactaaagccacccagaatatgtccccattttctccctgttccagatagaaaatcaggctccctgcctgcgctgtggcacattttccccccagtgcaggttacaaagcagcacatgctaccttgtatatttaatgctcccactgtttggagttaataggaaagatacattaattatatttcactattatcataatagccttttgttcttgtttttttgagacagagtctcactctgttgcccaggctggagcccactggtgcgatctcggttcactgcgaactccgcctcctaggttcaagcaattctcctgcctcagcctcccgagtagctgggatcacaggcatgtgccaccacacctggttaatttttgtatttttagtagagatggggttttgctatgttggccaggctggtctcgaactcctgacctcagctgatctgcccaccttgacctaccaaattgctggggttacaagcgtgaaccaccgcccctggccccatagtagccttttttgggtactttccaagttccacaagctctatgctaagtgttctatggtgatccctgtgataccaagcatcctacccgtgaaaaagcatgatgaagaaagtgaaggaatttgctaaccttcacgcaagctacagagaccttggcttcaaaacaggattacgtttctttccaaagcccatacttttcactgttttgtcctacacaggagattcccgagctaaaaaaagaacattcagtaatagctgaaaagaacgttccgcaataagaaacaactacactaagaatgcagcccttcatagtttgatctgaaacggtttcatccaggcctgtattctccaactcactttacccttaggatgaggtttgttattgttcccagaatacatagctgcccttcagcaaatgaacagattgtggggcagccccactggcccagatagtctgagccatatgattcaagggagctctgatgagactttcaaactgcactcttcatactcctacccctcctcccaacacaggcacacttgtacctttgagcagactatccatcaaagtacacactttcatttaaaaaaaaaaaaaaaaagcatccctcatctaggatcagaaagaaatgcctttcatttatctacgctacgcctagttcaatcagctaatggggagctattaaacctaccatacctatgattggtctgaatgattttctaattggtttccctttatccactcagttaaactccctaaaattgttcctactggggacctcataataaactctgactcaacgttttgcagccggaatcgacgatgcatgacgcagccatccatgcgcccaccttcctgaaacagtcctttcagatttgaaggccttctctgtctgaccccggaggagagacagacagtccatgtctctgggactactacttcataggaaatgaatggcaaaggcaattttcaccctcccaccgctttgagcctcagcatctctgtcctcagccagcagcacatgtgggagactccacaacttccttttgcatttttagcagttttctttccttttcctagtcatcttttttccttttgtatccttaagatagctaggcctgtttgttcttgaatggagacccagcttccaaaataattgaaaagcactgtgaaagtcttgagtcccttagaaaacactaaagttgccggggcaccgtggcccacgcctgtaatcccagcactttgggagggcaaggggggtggagcacaaggtcaggagttcaagaccagcctggccaagatggtaaaagcccgtctctactaaaaatacaaaaattagccaggtgtggtggcaggcgcctgtaatcccagctactcgggaggctgaggcagggaattgcttgaacccaggaggcagaggtggcagtgagccgagattgtgccactgcactccagtctgggcaacagagcgagaccccatctcaaacacacacacacacacacacacacacacacacacacacacacacacacacacactaaagttgcatccattcatggcacggacaaaacttctcaaacattttcttttcctgtgtacatcccttaagtgccgctgctccctccaaactctcccctactctgttcaaactcttccagactttgaaaccttgctcttgccatttcttggcaatctttattcacccttcatatctagtctttaatctttcaggagtaaatccttgcttttttttgaggcgcatcaatcaagcaggcctttgatcttctcagtttccttctcaccatcacggcagcggacacagcagggccggcagcccagcaatgatttctttcgtgagaagaaagaatagggctcaaatcattcctaggtattttcctacttacaccttcagtgcagaaattattgtttgccagcctttaatgtgccctgtgctaagcactgaacattgaaaggtggattttaagacaagccctgtgccctaaagttgctcatagtctacagggaagataatagggtagagatgctactactctctcctccttaggatccattagacttaaatattacctaactaaaagttcagttccttagtcacactagttacatttcaagtgttcaataccacatgtggccaagtggctaccatattggagagcagcaaggacagaacatttccatcattccagaaagttctattggacatgtctattcaagtcttcacctccttttttgttcctattgaaacaaccattttactagacattcttttttttttttttttttttgagatggagtcttgctctgttgcccaggctggagtgcaatggtgcgatctcggctcactgcaagctccacctcctgggttcaggccattctcctgcctcagtctccagagtagctgggactacaggcgccctccaccacgcccggctaattttttgtatttttagtagagacggggtttcactgtgttagccaggatggtctcgatttcctgacctcgtgatccgcctgcccgggcctcccaaagagctgggattacaggcgtgaaccaccatgcctggctacacattctttttatcagcagtaatgtcttaggaaatagctgtcacgttgtaggaaaaatggactatttctccattgagaccctgtccatctttggctccgatgagaaatcaaaccatcattactctatcttctcccctctgtggagaggtgagatggggctggagaggctgagagaacaggaacaaggggcacgcccattcagtgatactttctgtgagaagaacctgatcccagtgacgtgatttaagaactaccctctctgtgctagctgtgactcttgtacagcctcctcttatggaactgtcatgccgtgtagtcattcttttgttgatctctgagtcctggaaggcagagatgtcattgtcactgttgtgacattagtgcctagccaagccccaaaacacagaggggtctgttgaatttcaattggatgacattaaatgttctatgcaaccagtcactgccgaacacctgtttgaagtgaatgccttggtcaacatcaaacatggagcataaagatgttaacctttacaggaaccttaggaataaatacctcctgctgtgtcccgaggaggggctgagagtaaataactccaggtctcaaagtcaaaagagttagtctcagcatctaggagtgcttgttttggaccctttcggacctggcttttctgtttctgctgaaaactggctctagacatttagattctcaatatgtctcctggctgttttgttctgtgttggaaatactactgaggtgtgttttgaatactaatttgggcatatgatctgaatgtatttcttttcccagacacggtagaaacaaagaacttgtacaactgtatcccaagctatattaccctcatcatcactgccaagtcacttcctccctcctctctgtccttatttcagccatgctggccatcatgatgagtttgtccctgggattctacgctttcccctctccttccccttccatcttttttcctctctctcctcatgagttggcatcttgtgctcctgctacaatgagcttccttcttgaggctggaaaaggcggtggtctttagctccagcagccatgtacaaatttagcaagtcccactgcaaagagaacttttttctcccagtttcctcccagcatatgttatggacaaagggatctcagtggggcagtgacagcactactaatgtaaagtggtagattatgaataaaatcagatgggtcggaaaactccgtatgtctcccgtggctgcagtggcttgcttatcttaaaatagtggttagagagggtggacagggttatgtggaactggtcaccaaggggaccagtgtcaagagccatgagccagcagtgtgggaagggagtctgagcatcccagcataccctttccagcctctgattgaacacaggtggattcttcaggtgaatcctaagacctctctgagacaattctggctgttctcaaataagagctgccatctgagatttgcataaacagtgtccttgctttggtcactgtgagctttttctttcctagcaaatttgtgtcagtctgttcccacagtcttgagataacaaaactggcacttgagcaaatcaaaaaagaaaaaagatttatgcccaagattttctgagatcaatgcctattttcctaagcattttcaagttttcagttgagattaagaaacaaaaacaaaagcttcagttctggggcaatgagaaaattaatcaaacatctgcttctttgaccccgcatggattgggagttaagtgctttgatgaacatattatcagcaagacgagagcagaataagcaaagagcacaccttcccttactgcgtctgcttggcacaaagcctcgcacgaggtctgcttgcttctgcccggagctggcaaaggctgccacaaatgcaggactggttaaagttccgaggcagagggctggtaaagctttctattgagaatttgatggtgctttccctgatgcctgcctctccgccagtgtcgtgatctccgacttcccacagacacatagaaagccctgaagtgtgatttttcatagattttccccaagcagtttaccaatcctgcatgtatttatctgcttgttactttttgtgttattttttccttagtctctgcctttttttttttttttgagatggagtcttgccctgtggcccaggctggagagcaatggtgagatctcagatcactgcaaccaccacctccagggttcaagcaattctcctgcctcagcctcctgagcagctgggattacaggcgcctgccaccatgcccagcaaatttttatatttttagtagagtcagggtttcaccatgttggtcaagctggtcttgaactcctgacatcaggtgatctgcctgccttggcctcccaaagtgctgggattacaggcctgagccacagcacccagcctctgccccctttttaaattcctcgatctctttctttttctttctatttatttatttacttattttgagatggactctcgctctgtcacccaggctggagtgcagtggcaagatctcggctcattgcaagctccgcctcccgggttgaagccattctcctgcctcagcctcccaagcagctgagactacaggtgcccaccaccacgcccggccaagttttttgtatttttagtagagacaggtttcaccatgttagccagcatggtctcgatttcctgacctcgtgatctgcccacctcggcctcccaaagtgttgggattacaggcgtgagccaccacgcccggccaagttttttgtatttttagtagagacaggtttcaccatgttagccagcatggtctcgatttcctgacctcgtgatctgcccgcctcggcctcccaaagtgttgggattacaggcgtgagccaccgcgcccaggctgatctctttatttttctaatcttcacttcctttttttctatgggaacaactgtttttactaaacattacttttatcatatcttttatgatatgataacatatcataaaacataagaactttattttaacatatcttaggaaacagctgtcatatcatagcaaaaatggactgtttctccatgggaatgctggtccttggtggctccagggagaaatcaagacatggccactctgtgctgtcttctcccttccatggaaagctggggtgaggccagagaggctgagagaatgggagcaagaggcacgcccattcctaagggatactttctgtgagaagcacctgatcccagcaggttctttcccctccctctcattctttcaggtttttatttaaaggtctcattctctttcctgcctttgcaccatttgttataagaaccaccagatctttcctcctcaggaactgccgtgcaaaggagcctcataaaaattcaccatcagtgacagctgctctgtgaccacaggggaataaaccctgaaaggagagatcacactactcttcttgtagtgggagctagtgtgcaccacccctaaagcatccttttagaatctcagtgctcactcccccagctaccaggaatgatggcagctgacagctcacagctggtttctcctgaggaattgttctcagccaaagaaagtctccttccccaagcctgcaccccctccctgggggcagccctcattcctgactggttgatgcaggggtgcaaaggcccagtccccatgtctttgttcagaattactcaaggaaccatgctatgtctggaactttgcaaggatgaactgagacctctttactggtatatcagagttcaacttctccccgtccccagtccagcttccctcctgcccatctaggagttgtcttttagaacactccctatcagacctcttgctgcaaatctcagtctcggagtctgtttcccagggaacctgacctatggcattttctttgtgtcatagtgatgacagtgattcggatagcaagcttatatctgttgagcatttactgtgtacgaggtactctgttttacatatactgtcacatgcaatccacacaacaccccgtaaggtggttgtgttactatcccattgttgagatggaaaaactaaggcccaaggtcaagcaacccacttgaggaggagccagaaagctaaagctaaagatctaaacttagctttggtgattgcagaggactgcttggaataattctttggggagaactttctggaggttgatgctttgacttcatggttatattgtacattagcatgtgccatggtggctatatgagcactttgcctatactccagaacagggctccctgggccacagaccagtactggtctgtggcctgttaggaaatgggccaccaagcaggaggtaattggtgggcaaggaagtgaagcttcgtctctatttagagccactacccgtcactcgcattaccacctgcactctgcctcctgtcagatcagcggcagcattaggttctcataggagcatgaaccctattgtgagctgcacatgtgagggatctaggttgtgtacttcttatgaaaatctaatgcctgatgatctgtcactatctcctgtcacccccagatgggaccgtcgagttgtaggaaaacaacctcagggctcccacttgattctacattatgctgagttgtataattatttcattatatattacaatgtaataataatagaaatacaatgcacagtaaatgtcatgtgcttgaatcatcccaaaaccatcctcccacccctgctccatggaaaaaaaatgtcttccattaaactggtccctggtgccaaaaaggtttgggaccgttgctctagaagaccacttgtcatcgtacagtgatcagttttgtttctgtttttgtttttgttttttttgaatcagagtttcattcttgttgcccaggctggagtgcaatggcgcaatcttagcacaccacaacctccacctaccgggttcaagcaattctcctgcctcagcctcccacgtagctaggattacaggcatgtaccaccacacctggctaattttttgtatttttagtagagatgatgtttttccatgttggtcaggctggtcttgaactcccgacctcaggtgatccacctgcctcagcctcccaaagtgctgcgattataggcgtgagccaccgtgcccagctgtgatcagtttttatgattctgtttccccatgagaatttggagccccttgttaactttgggcatccactacctagtatacggcatagtatacagtaggctcaatgtgctagttgagtggagagttcttgtctttgtaactgggaaaactgagccatgatctttctctaggagagcaaagtacattagtcaagagcacaggctctggatttacatcacttgctttcgcaagtaatgtaagccaggtaaaaccaacattttgtaaaccttaatgtgctttggttttgttctttgtaaaatgggggtaatattgttgatctcttagcattgtttatggttgttgtaaaactgaaatgacactcaacaccatgcctgatacatagaaagcgccccataaaagttacctattacaattgctagccacaaatcaattcttttccttcccatcctccatcatcagagaaattagaaaggccagatttctgttagcttcttggggatgcctccaacagtcacaaagccctataggacagccctctcagaaagagtccattcttttttgatcttttttttttccatgggaacagctgacattgggctactcaagtggtcctttgcaaccctaacagcacatgagagtgtgtgctttcactaaagagactctcagagctggggccaggatgtgcactttcagaaaaaataaatgtcatgatgatcctgacttgcattacaaaaagtgattgtactcaaggctcatcccctcttctcagcaattgctgctatgggtagagggaggggatctactgccattgcccacaaagagagagggttcatagtctttatcgagtttactacatgtgacttcaaggtgtcttggaactatttcatagaatcatgagagctccagatttgaagaaaggatgtcagctagtcttgtgttttaaatttcctccatgacatccttcatggtcttcacaaacatccttagtaaccaggaacggggcagcctgtctgatatttttatcagcaacttggatgtagaagctcgtgtcatgataaccacattttcacaggctacaaatccaggagggagaattaattttttttgatgaaagaattagaattcaagaaagagacagacaaatgagaatgatgaacttaatctaataacaccaaatctagcaaggataactataatcctctggactaagatcaaaaattcaactgccctagaggacaatgagaacttttcatttactttctatttaaccatttaatttgtactctgtctcatttagcaaaagacttgaattagctttaaaaaataaaacaagatcagtgattctctaagtgtggttcccagatcagcagcatcagcattacttaggaacttagaaatgaaaaacttcagacctcgccccagatctacttgagtccagaactcagaggtggggcccaaaaatctgtgttttaaccagccctcctggaagttctgatgaataataaagtttgagaaccattcacaatactactaacactggtaatggagtataaggatttaaaaaatggaatctccaaagtactcagaggttaagatgaagttgattattaagatgatatagaggccgggcacggtggcccagcacttcccacacttcccagcactttgggaagccaaagtgggaggatcacctgagcccaggaggtcaagactgcagtgagccatgttcacgcctctgcactccagcctgggtgacagagctagactctatctcaaaaacaacaacaaaaatgatatagagaatgaatgtgacaaatttggctcagagcttcctagcagccaatgcaaagaaataaacataaccaatgtatatactgtactgagcctataagatccataaagccaatccttgtgctgagatttgaggaaaaagtactgtcttcataaagtcgtaaatatatattgtagcaaattatatacttaacaaaatccctacagtaagtattaaaagtaatggcacaaaccacaattacttttgcaccaacctaataaaacaatgggtttctgaagattctttggcagtctgtctcttaattgaactaatgacagaacaagacttgggatttctattgagtataataggaaaatataggatgaggctctataatctgcatcaatagagaagtaggtttcggaagagggagatttgtttaatgatctgacactgtttggattttcatgattgatgctgaggatactgacaacctgaggaaagaacaggatagcaagaggcctaagatcttttcatatgagcaacccctgcctctttttcaccaggagagtagaagacaagggagcatctccatgctacatgtatctttgctaaactccttcttttgagtcacttttaacctcaaattggaaaattaataaactatagctgggctgattcttttgtcatccacttagtgatatcttttaagaaatcaaatgtgtcttcatttgatattgttagcatatccaaaaaaaaattccaaacgataagctttggggacaagaagacacagcggcctaccatggtttatagatcacacaatgacagcctggtggtcagaactcaagcttggcagtcatataaaaagggcttatattcccagttctggtacgaactatataaccttggacaaggtactttattctcgcttggtctcacctcccttttgcacaaaatggagattaaaacactccatcccttaatacctaacatgtagcagtatcatcacgggagcaatgtttgttgactttggcaagacaaaaataaaggcacctaaccatctctcaggagactttacagggtgatattcatcacttactaggtaacagaaaagaaagtgtagaggccaaggctagcttttaactcttatataaagtctaagcatacaagtcaatgtctttttctcaagaccaccaagcgtctcttcctctctacctaagctttgattttgataatgtttgaaacagagcccacaggataaaggaccatcaaacaaacagacgatgagagctggggaaggcttcagagactcagccaaactccaccgctaattgatggcagcacagggattaaaacccaagcacctgcatctgtttcttttcactgtttcctttcagccttcttgtccttgaatctttttttttttttttttgacagagtctcgctctgccacccaggctggagtgcagtggagtgatcttggctcactgccttccaagtttaagcgattctcctgcctcagtctcctgagtagctgagactataggcgtgcgctatcacgcccggctaatttttgtatttttagtagagatagggtttcaccgtgttggccaggctggtctcgaactcctgacctcaggtaatccacctgtctcggcctcccaaagtgctgggattacaggcgtgagccaccatgccctgccgttcccgaatcttaaaactcttgattttagtaacatttgatttacttgagatttcatggtgttatgggatacacaataaggaaggagttggaagacctttattcaagtctcggctctgtcactgtcatgtactgtcagtggtgttgtggtgcctttaacaagtcagttttcttatctgaggctcaatgttcacatctatttaatgggattaacggtatctgcacttgttttctcagcttgttacgaattttaatgagatgtgtatgaaagcacatggtaaaccatgctgtactctacaaatataagaaagtgttattattttaaggaactgtcccccaattttcctgtatcttccctaacatatcttcagatccctcattctaactgttgagcttttcagggtctctttttcaaacctctatcttcattccttcaggatgccatgtctcaatgataactctttaaacctagcctctgactaataatttagtatgggaagaaaactgagacagtcttatattatttattaaaattataccaatctttgagaaaaataggattacctggcagaactttatgtcaggcactttccaacactatttctttttttgcaatgatctgaaatgtttaagagctgtataaaatttttactccatttgtgggcctgagtcatcaggcatagtcattgccacccccaaaaacattctaactaagaatcagattaccttagagaatactggaaactgtaattgtgcaaaacaggggcattgacatgcccctgtttttttattttattttattttttctgttgtggtagaaaaagaaaaggattagactcaagtttttaagttcatagatttcactatttactgtgtggccttgggtaaataacttattatctctaaaccaacaaagttatttttgtctgaagaaaaaaaagtagagtcaacaatgtctgtcccaatgggtgattgattacggtattcgtttgagtttgtatcttttggtttcatatgacagggaccacacaggtagtccaagcaaagagcttctgctataaacacatgtgtgaagtaatgaaggaattcatggaaatcatagagcaggaggtgtgatggagctggacctctccaagcccagagactggacctctcctcattctagggaactcagcaatggaagtctacaaagcctcatcctggtgcagggagttgggttgactctgttgctgttcgtgttttttcttttaattcttccagctattggcttttccacgtatgcttccccaaagctcaggtcaactagatctctgtcactcacttctgtcttttgacatcctttctattgctaagtcgttctcttgatgtgtgtttcccaattcatagttttacagagaacacccagttcttggaccagctcatttattcagtttaaggaatgggttcccgtctagattatgaatggccactcctccaatactgggcccacattggtgcagtcagttctctgcaagggggaagatataaagagctataaacatggctcttgtatgggcaagggcggggcatagagaagttccccttaaagaggtagagtgtattgcctaaggggtcaggttctaggctttgcatgaattcagatcctgactttgacactttgaaaagatgtgatggcaagcaagttacttacgctctctgggtctcaattttctgatctgaaaaattggtatgatagttcatacctcataggaggagtattgatgagtcttaaataacaaaagtcaagcacttagcacagttcttgacacaaactaaacgctcagcaaaagctagctatatccaaatcaggagaaacaggtctgatccaacactcgggagtactctgttaacaattatttacatcccctttgtgtggaaataaacaatactgacctgtcctagtctccgtctccaaaatacacctgcgtcctaaaaatagggggcattctccatgacctgacagaatcgcctaatgcctcactgaggaaacagggtgctacaggcttttgaaaagtcagtgttagcctcttctcattggaatttaagtagctggctctcagtttaccatcactgggcccagttcatgctggatggcgaatgcaggcagcccagttgagcagcgtaataagtgtcgaagatgaggccttctccagggggctgccatgtttgcagaaatggcaacaaatttcttctagcatttttccaacagggccttgggaaatcattggttttcatgaaaagaaaaacacaatgagctaaaatatacatgaaatgagatggagtgcttgattcaggttgtagaaattttatttactgttatacagtgatgcgttatttatttgattgtgtcagaaaatcggccattttatacaagtgaagttcagagatagctgaagtttttccatgtcagctgtgaaactgtttttaaccctttttttacgagtgccttcctaaaatatatcacatacttctgccttcttaacggaagatgcaaatttcaaggctaacatgtattgaatactgactatgtacgtggcaccacatgtcagtgctttatgtgcattaattttcaatgacagccctgtgaagtaggtactgtcataactcccactttacagatgtggaaactgaggcatggagaagttaagtaacttttcccaggttatagagatagaagtggtagaattgggatttgtaccccagtctccccaagctcttaaggaagtggccatgttaaattattaacatttcagttaataaatgacctggataaccactaatcattgaagtaggatctttgggagtctacaaatatcattcagaaatgtatccattactccaaattctttgactgctttttagaaggaattagcactcaaactggcagcacatatttttgaatatccatgactattccttcattcagcagatgttacttgagtccctgctatattactttgggtctgatgcatgccaggcacactggaagcagagaaatatgaggcatacagatgccttcaaggaggttgcactttagagaaataccagccgggttcagtatgtgaaacttctctaatttgtggttgggaaaactttgagaaggtggtgagttttgagcccagacttcaaggaagtcgtcttactcacctttattcagtccctgtgtatgagactcataagtgagaccagtgggcataggtggagttagatgcttccttgggtccaaagagaccagggaagaaataagcaagatgtgctttagaactagttcaagttggctgggcacagtggctcatgcctgtaatcccagcaatttgggagaccaaggtgggcggatcacctgagttaggagtttgagaccagcctggccaacatggcgaaaccccatgtctactaaaaatacaaaaattagccaggcgagttggtgtgcacctgtaatcccagctacttgggaggctgaggcaggagaatcgcttgaacccgggaggtggaggttgcagtgagctgagatctcaccattgcactccagcctggacaacaggagcaaaactctgtctcaaaaaaaaaaaaaaaaaaaaagtacattagaaccacatctgttgggaaaaaatgcatgtttaatgggatgtgtttccccatgtgattagcaaatgggtgttaaatggaattcccaagagcagttctgataaaataaaaagagtccaggagcattgctaatagcgtcattggaatcaagtgtatggttttccattatgatgactttgatatattttaataactttcttattccaaaagtaatgtgttaatcaaaaatatctaataatatctctcatctggaaataacttagatttttgaaacactccagtattcccatatctattggggcattcatttgatctctctttgagtcccctctcctccagtggaacataatgtaatctcctgatggcttatattcaccattgtgggagctgtttatgcatagtgctgatgtaagtgtgtgtgatgattgaggagaggtggttggttgttttgagaccttaggtcttctttctctttctcaggcactggctagtggccattaggtctggctgctttccatgtgtctgtttataaccacttcctggtaaatcttttacctttgattaagtactaagaactctgatagccaggctagtcaatatgtttttagagtaagcataaacaggctctgagagaagacaaaggggccatctcttgaatcagtgtaaactctgcaactactgttttcattgccacaaatgtattgcttatctgcatagagataattgaattttgcattattggtgacatctagctaagcggcattactattagggatactttgccaaaaagaaaaaaaaaagacaggaaggagtgaagaagggagggaggaaaggaggaaaagaaaagaaagaaaagaaaaccaggtcggtgctttcttttggatctcattttgaatttctctcctttcacatttgctctttacagtggattaaacttcattgacttgatggtgcgacaagggaatattgacaaccctcccaagactcccctggtgccaggatttgagtgttctgggattgttgaagctctgggggacagcgtgaaaggatatgaggtaatgtttggctctcaattgaagagtaatattcatttggaatccattgagacaacaaaagatgatgcagaaagaaatgtctgaaataacctatggcgtgcattattatcattgtcttcttatttggactgttgacaatgtttatagtcattaaggtctcatgccttttttatagactatcttggttgctcctggcagcattctggtgcagggggcaggacaaatcttgtctcccccttcattcatgtcatgcagctattcaacaaaagtatttggcatttggattaactaagtgtgcatagccccttcccatatccggaactctcattttctgatcatcttcagctcaaaatgcaactacaaaacacagaagtgtagaggaaatggactctctattttataacctggctccctcaaatagtcacttaactggtacatttaagtaatcatttataaatccctaactacttcaggaattggggaggtagcattttggatgaagaagatgttaaagtcaaagagtggaggtacctgataagtagaacagaactggccatggattgatggctttggaagtagggaaatgggcaaaaaggtttattacattatgctgactacttctgtacatgttcaaaattctccataataaaaccttttttaatttgtaaaaagatgtatgacccttcctactattataacgcaaatcaaatagaaaccagtctataaaaactgaaaacctgtgcacaagtcaattacacaaaattgcagtagtttggagtcagaaaaaccaatgcaaatcaggtacaagggctcttactcataactaagtgctcccctagggaggaatgaacatttgagaacccgctataatcagaaccatggagaagttatcttttttaagcctccaccatagccctgcaaagcaaagattgttatccccttgcagatgaggttcgggagggttcagtaattttctgtgaggtcagaagggtagttagtaccactagaacccggattcaaatcaccagagcttgtttatccttcctacagtctcatgatcttcactccctactcccagcccccaaatactgcaataataaatgcaggacaggagagctaaagaagaatcctataaaatgcagtgccaaaatgcccttgaaattgaatttgagcctgcttctcagtctcagcgtgtctgagcctcagtatcctgtgaaaagatcaatatgctccaaattcattatgaaaaatgtctggaaatctcatcccatttattagtatttttgccaatggttttcagataagacagcagataaatgttgagaaagaggcagtaaatgagtcttttcttttcttttatacgaatttacatttttttgtccccaggtaagcagtgtaaccaaaggcacactatctcaccctgaaagtgctgcacataagaaatattatcttctcttcaatcctccacatggtccccaaagaaaagatcatgcagctcactccgttaaccccaagcattgaataaataaccagttattttagaatataacaggaaacagggacattgttcaacttggtttagagggagaacttactatacttgattatgtatatttttcctttcaatatgacttatcttttgctaatttgccctggcttgtttactatcaagcccacccattaaactctctcccttccagtgacttgtggctgcacaaaaaaataagtcacttactcgtttccagttagggtgtgatatgggagaaaactgacactagtattccatctataattttgacttaagatcttcagtcatattggagatggaattccttgcagcagcacactgaatagctctcttggtttgatagatcgcaaaggatgatgaaaagctgtcaccggaggccgggtaataaaggaataacttgggtgcattttggccaggactgattttttttttcttagcagaatcaaataatgagatgaagtggttatgttttaaatgtgcctgcctctggactctgagactggagctgaacctatggcttggacatatttgctattttgataatgaaatggaagtgatggagcaaagtcaaaggagagatctgggagcagccagccctgtagtgatggccatgagcaccactgccaaggtggttgaaatattctgttcattacactctgtgctgaccctggaggccatcagctattctgtgggactgaggctgtgtctttgggttttcgtgattctgtgaagaacaggatgctagtattagaccctagttatcttctgatgcactgaagatgatattcttttcttttttcttttttttttctttttctttttagatggagtctcactctgtcacctacgctagagtgcaatgccacagtctcagctcactgcaatctctgcctcccggtttcaagtgattctcctacctcagcctcctgagtagctgggattataggtgcctgccaccacacctggctaattttttgtatttttagtaaagacagggtttcaccgtgttggccaggctggtctcgaactcctgacctcaggtgatccacccgcctcaacctcccaaagtgctgggattacaggcatgagccaccgcgcccagcctgaagatgatattcttcacattcactaattggtcttcaccccttccggggattgggacactcactgacagtgggacagcctctcttaccccagtttcctccttagacagctgttcctcctgctttctgaaatataatgagtcagtatttaactgctgattgctaaactgtgaattccatcaggtcaggaaccaatctgttcttttagagcaaacatgtattgctctttcctcattttccatgcaccatgttaagtgcgttgggtgtgtattatgccatttagttttcataaagaccctttactaatattatacccatttcagagctgaggaaactgagccctgaaaagttcaactaatatttccacactttgtaggttcctctgttatgcacccttatataacgttatgtttcctttggagcacttttctcaagtgtaatgaattaattatttgtatctggaatcagactatctgaggccatttctttcatggtttcaagaggattgaggtagactcccgcacctggtcagattgaacttttacctaacactaggaggagatgacaatagtcatggtgactcccagggtttccgtgattctccctctacaaatatattagaactaagaaaactcaccatggccttggctgaggctacttccagctagatgaaccagtgctgctttagaatccccctaaaatcagcaaaaacacacatttagctgaagaccaaaccccttgccaagaaaaggaaagctcatcgatgctcacatcctcaagctcgagctctgtaggggtgtttcccattgtttctgtatcttttcctgcagaataagagaaggaccctcaaaccagcatgagccgtcagtcaggatagcctcctcttagtaacagcttgtcttagcaacaccaagaagatggaaactggctagaacaaaggagagctctgcagagagacagatctgaactggaagccttctgcttctgctcttcaaaggctccttcactttccagcttcaattttccaatctatataaagggcacagtcatagttcattattagtcatgaacttcaagaactacatggagttcttgtgggaattatataaggtcacataaataaaggcacttagcgcagattcaggaacatattagtttttgttttggtaaatgccatttattattatcaataacaatagcacctagcagccccttccccagtagtttccctgccccagcagtccctgccctagcagtgcattctagtcaattgcagacactggttttcccctttagacctacagatgtttcctatgagactactgaaagcttctccaggactgaatttcttcccttattctctcccatttcccacccatggagaagttagacaacgttcagttacttgtaattatccatcaacccatcactcactatgcaccaagcattgggtcatgcattgagaatccataaatcaataagacccagcctctgccctctaagatctccccatttagagagggagctagtcatgtaaaaggataagtcaatataatgggatctgcataattatgaaggattatataaggaattaggtggacttttgttgaaatcttgtcttttttttttttttttcgagatgggagtctcactctgttgcccaggctgaagtgcactggcatgatctcagctcaccacaacctctgtctcacaggttcaagcgattctcctgcctcagcctcccaagtagctgagattacagccacacctggctaatttttctgtatttttagtagagaaagagtttcaccatgttggccaggctgatctcaaacccctgacctcaagtaatctatgttcctcagcttcctaaagtgctgggattacaggcatgagccaccgtgcccagcctgaaatcttgtctttaccacttacaactgtgtggtcttgggcaagttatttaactgctctgagctttaggtcccagtctataaaatgggaacaataataaaagcaaccataaggagttgtcataagaattaaatgcagtaatttaatttgctgtctactcagtgccagcacacaagcagctctcaataaacagagatactgacagcaataagaagagatgtcagttctgcttttgtaggggaaggttggtcgtcagggaaagttttggagaaaagaacatttgagctgagctttaaaggaaaatcaaatattttcctgaaagaaagacagcaccaagtgcagaaatagtagatacaaaagcataagggtgtgagcatgcactttctcgtgtttcctgctgcttttccagcatgcccataagggagacacaggcgtcaatactgaacaggcacaggggctgatcctttccttctcctttgctcacattgtctgagctcccacccactgctgccactttttattgttagctcatgttttattttatttatttatttatttagagacggagtttcgctcttgttgcccaggctggagtgcaatggtgcgatcctggctcactgcaaactctgcctcccaggttcaagtgattctcctgcctcagcctcccaaatagctgggattacagatatgggccaccacacctggctaattttgtatttttagtagagacggggtttctccatactgatcaggctgggcttgaactcccgagacctcagcctcccaaagtgctgggattataggcgtgagccaccacgcctggcctggctgatgttttattcttaattgtaccctctctggaacagactgctgtcaccactagtgtggagagccacccccttccagtatccaagaaatctagggtcatttaggggcttggaggaggggagagaagaaggcatgtgggggctgagccacagataacatacagataaatctaggcaaggacctctccctctccagcagtcctgggaggattcagagaggggaagacctgcttaggtttatgccaggctacccaaggataaggaaaggagatgcaaggaggcagtgagaatgtcctccttgcccagctgtcggatcatcacattgattaattacttgcctcttttctcaaagcgagcagaccagactttgccttgctcttgttgctgtcacgagagccccagaagacacactggggcagagcaatttgattctgtggttcaggtgtcttttctgaattaggtaacccgaacccctgcccccgacagagctgccctggcagctggagcagaggtggccagactcacttagaacattgttgatgctgtctccaactgtctcattcacctgaactcctcattacccaggtctgaatggtgccaagatcagtctgttgtctttatactatatcatcctgtagccaaacggacaatcaagtcctctggatcctgttccagacacacactgaggctgaagcagctctattccaaaatacgcagaactggccaacctggaaaatccccagggttttgggagcgctcacctccaggctactctgacatcccttgaccccacccaccattcccacacccaaaaaatgaactctgttatctttggaccgatatctgaaacatcgtcatcatagtttcatgcttttggcttaagactgcattctcttctgaaatattatcccttccaagtagattttcctctaagccctatcactcatagcacttgtcatatgaaaatatcagagaatatgaataatttgaaagcatgagctgtacctcatttacagttttatctccagtgcctagaacctaagatcaaaaaggggcttcatatgcaaacatggcgggtgctcattgtgatgtcatggaaaaatatttggaattagacaggcttcactctgtatgtcattaggcaagatactcaaccattcttagtctcagtttcttcaaaattataataagaataatatcctattaagctttcatgtagattaactgacaaaatgaagattacagtctagtacattatgattgtttagcaaatcatagatttcatagtgatcaaatgtacatatagaaaaacctctcagctgggtacagtggctcatgcctgtaatcccagcattttgggaggccaaggcgggtggatcactgaggtcaggagttcacaaccagcctaacatggtgaaaccccgtctctaataaatacaaaaataaataaataaataaccaggcattgtgatgtgtgcctgtaatccgagctacttgggaggctgagacaggacaatcgcttgtacctgggaggcggaggttgcattgagctgagatcgtgccattgcactccagcctgggaaacaagagcgaaactccatctcagaaaaaaaaagaaaagaaaaagaaaaacctcgcatgaggaggaatccattctccagccaggctgtaagttcctcatgtttggctatggggactacatttttgagaagtcctaaaggaaggacagaagtttgccaggtgaaaggtggtttcagaagaatgaaggagggctctgcattgttttgctaccttccttagatgcactgacacttcccaggactttcactaccacctaaataatgttcagagtttcaaggaatgggttctcaactaaccaacttagctggttctggagaggagagggtagtggctgaagatgggtggacaagaaacatagagctgtcaatggttcattaaatcagttgtattacttgtgaaatgtattagctttttgcactgcaaatgtattttaaaagttattcgtttcatcaaagtattaaaaaatgattgtgggccaggcacggtggctcacgcctgtaatcccagcactttgggaggtcgagacaggcggatcatggggtcaggagatcgagaccatcctggctaacatggtgaaaccctgtctctactaaaaatacaaaaaaattagccgggcatggtgacaggcacctgtagtcccagctactcgggaggctgaggcaggagaatagcgtgaacccaggaggcagagcttgcagtgagctgagatcacgccactgccctccagcctgggtgacagagcgagactccatctcaaaaaaaaaaaaaaatgattgtgatactaaaaaatttggatagagttctcaagtgtatgagtcaggaaaaaccatgtgtttgtaccgtggatagctcccaataatgctttttttttttttttttttttggaggcagagtcttgctttgttgcccaggctggagtgcaatggcatgatctcagctcactgcaacctccgcctcctgggttcaagcagttctcctgcctcagcctcctgaatagctgggactacaggcatgcgccatcacgcctggtgaatttttgtatttttagtagagatggggttttaccatgtcagccaggctggtcttgaactcctgatcttgattgattcacccacctcagcctcccaaagtgctgggattatacgcatgagccacagcgcctggccagctcccagtaattctgttctctccttgagcctctgtcatgaggtagcctccactaactctgtgtttccccatgcccagattggagaccgtgtcatggcatttgtcaattacaatgcctgggcagaggtggtctgcacaccagtggagtttgtctacaagatcccggatgacatgagcttctccgaggctgctgcattccccatgaacttcgtcacagcctatgtgatgctgtttgaagttgccaacctccgggaagggatgtctgtgctcgtgcactcagctggtgggggcgtggtaagtcagctgtttgtaacttctcttctttaaggtcatgatggtggaagtggagtgacacccccctgaggtcttatgtgagctatgtcctttagcaggaatcatcactatggttctggtagagttcacatggacagcaaagcccatatagatgattgcattggggtaggataagcctgagagatggtttctctggagttttggaaggtcaccaaaatggcctgtgaggacacaatggctttcagagatagttcctgttgagaagcattctcaggccgggcgccgtgactcacgcctgtaatcccagcactttgggaggcagaggcgggcagatcacgaagtcaggagatcaagaccatcctggctaacacggtgaaaccccgtctctactaaaaataaaaaaaaaaaaaaattagccgggcgtagtggcaggcgcctgtagtcccagctactcgggaggctgaggcagaagaatggcgtgaacccgggaggcagagcttgcagtgagccgagattgcgccactgcactccagcctgggcgacagagccagactccatctcaaaaaaaaaagaaaaaaaaaaaaaaaagaaagaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaagaaaaagagaagcattctcaacagtcttggtatcatgatgaaaagttgtgtcaatcattgtaagacgtctcacaagtcatctactactgctattatttgaaatgacaaaatggtcattttgtcagtgatttagttttttcaataaattgcagtggacttgagatggttcccatattaatgacattcttattaatttgtattctgctatattttcttgagtgggcagagattgtaccagcacactagaaatcatacataaacctaagtacattcatgaaagtggttgcacatgtcagcgtcatctgtcaggtgtgtctctgccaaggcggagaatggtggaaatcaaaatttctgctctagatttcagggatggcagaaacttctctcatggtttgtctgtgtctcattgccaggcattcagtgtatattgcatgcctgctacatggcaagcactatgtctgtcattggtctactggggtctgggtggaacgttagtgtttctgagagtggaaggtactacctactagttcaaaacatattaattaaacacataacatgttctagactctgtggatatagagattaatcccctatcttagaggttttgagaggttctcagagtcactgattctgtagtttgatgaactcagaaataaactcttaggatttggtgtatctcagagatatttcactggaggttttgctagcataccgttgattttaaaaaagaaaaacttggctttctgtaactattaaaactctatatagtgtagagcacatttccgttgtttgtatctaagaaaacaagctcacatccagaaccatgaaggcaaagataggaaactttaggaatgccttaagaaaaatatcttcaatcattttagcaaatttgctgatacctttcgaccatgaataaagacatataaaagctaagcatcccgtagaaaagaaatggctttcagttccagtgaatctgttaacagcaagcaagccatttagaatgctggcatttatgatcttagtgtgctcagcatacaaagtattagagacttgtagtcatactatcagcataagcttcagtctttacaatgacgctggactcagttctgctgagaattagtatttatacatttacacctatgatatttcatttcatgtttttatttttattgttttgttcttggagcaaagaagaatgtgtcaggggcatgtgtcttacaaaaggaaaataatcttggaaaataaaaagaagtttttatcgtgctctattctgggcttacagatgctaccgacaatactaactaaagtgtaaaacaggtgaaggaactggggaaagtggacaatgagggttggaaaataagtcaatgcacatagcacaggctatgttgtcctaaagctttgctgaagttgtacaattttgtctcttagctttctaatagtgagtgaaaatagggggaaatggtcatccatgtgaactagtgttcatttgattgaaataaaacagttactaggggtaaccataactaacactggttttggggaccagaggactctttctttctctgtggtttctcataagaaatgtatggtgaaatgcaataaacatcctcaacaaagctgttatagtaaatgcaactgtttccatgaaggtttttcttacggtgcactcttaatgtaatctaagagcatcaaagtaaagcaagatttagtgagagcatatattcttgggccaaaaggatgtggtctggtttaatcttcaggcagagttgaaaagtgcagttggacccatctctcagacgggctggtctctttgaatagcgttctctgaaacgagatttgataggtggtgtgtggcaattaaaggttaccattagagaagagatttttggcaaagtgcagatccacatatgtgaacactccgctgagccgggatgggtggggcactgtcttacaaaatctaaggagtcctgcagagagcccacaccatcacactcccctgcagggagagaccagtgagtccctggtacctgtatgttgccttacctggcaaaaggaactttacaggtatgactaaagtaaggacgttgagatagggaggttatcctgcgttattcaggatgacccagtgtcatcacaagagtccttaaaggtgggagtgggggccgggcgcggtggctcacgcctgtaatcccagcactttgggaggccaatgcgggcggatcacctgaggtcgggagttcgagaccagcctggccaacgtggagaaacccccatctctataaaaatacaaaattagctgggcatggtggcgcatgcctgtaatcccagctacttaggaggctgaggcaggagaatcgcttgaagccgggaggcagaggttgcagtgagctgagatcgtgccactgcactccagcctggacaacaagagcaaaactccatctcaaaaaaataaaaaaataaaaataaaaaaggtgggagtgggaagtagaagaatcagagagagaatgagagaagctacactgctggctctgatggaggaggaggctgtgaaccaaggaagcaggtggcctctagatgctggaagaggcaggaaatggattcgcctcttgagctttcagaaggaatacaaccctgctaagaccttcattttagccgagcgaaacccattttgcccttcagacctctagcaatttaatatcccaaatctgtgttttgagccactaagtttgtgttaatttgttgccacttatgggaaaccgatactaccactttcctggggctgcctctctccctcccttttcattatggcccgccagcagaggcctgaagaaaatcaaagtagcgaattgcagaactacgattcgtacctcaatttggctgattccaaaacctcttctctttccattcaacagcccaaaatgttgggagagccagcccagattcttcagtccttcatttaacaaatatttgttcaacctctacccagtgctcagcatagatgttttcaagatccaaaagacgggcccaggtacatatttgctaacttggtgtcgatgagatgacaaagaagactaaacctagtaatagctggggcaaagtttcctaaatagggttatgtaaagtgtgtagccctaatggcaccaagacttctgtccgagtttcatcaaaggctgagatggggaatttgcagacagcatgtgaggaataccaaacttagctatggttttaaggaaacctgaatacagcatggaaaaataattcaatctggagcaggatacactctcattggaattgcccactgcctccatgctctgtcatatctttgaggacattgttttcctctgacaatagcatgacaagatggccccaaatggcagtgctcttaataagatctttagaaactggttgaaaattgggtcacaatcctttaaaggaaaagtaacaaaataggtaacagaatgagactcatgttgggcctcgagttttgttgccagtcccgtttaatgagccttgttgataaagctgctatgactctgagtctcttaatccgggtgtgctcagtttctggagagtggcattactgttcctgtgaggttatttgcatttgtgtctgatatctgatgctttgcagttttcagagtcctcttacctttatcatcatatcatctgagcagagattactataggcagtaagcaagcatcattcccattttacagaagtggaagctgagggttagagaaaatgaagtgaacctaggtgccagcatgtgccccggcttcctgaccccatttgatgctgtcactggtccaccacctccagccagcccctcgaggaacatgagatgcgcctctattctgtgccttttcagaaactgtctcagggaagatgaggcaagatcagcactctgccctccagccaccctgaccttctcactctactcagaacactctttatcttatggtgtactcctaatgtaatctaatagcatcaaagtagcaaaatttgaagctctgaacctctgtgccttttcatatgctgtttttttctttccaaaatggtattctctcccaattcagatgtaagctcctctgggaagccatactgtcctctcttgtctgggtagccttaaccctttaataaaagctataggagaatccttacagccttttatttgtctatggtttgatatggtttgtctgtgtccccgccaaaatctcatcttgaattatggctcccataattcccacatgttgtgggagggacccagtgggaggagtctttcccatgctgttcttgtgatacggagtaattctcacaagatctgatggttttataaaggggagttcacctgcacaagctctcttccctgctaccatgtaagacatgactttggtcctcctttgccttccaccatgattaggaggcctcccagccatgtggaactgtgagtccattaaacctcttattcttttttgttgttgttgagatggagtctcactctctcaggctggagggctgtggcgcagtctcagctcactgcagcctctgcctcccgggttaaagggattctcacgcctcagcctcctgagtagctgggattacaggcccgagccaccatgcccagctaatttttgtatttttagtagagatgggatttcaccacgttggcgaggctgttctcgaactcctgatctcaggtgatctgcccgcctcggcctcccaaagtgctgggattacaggcgtgagccaccgcatctggccaaacctcttattctttatgttacccagtcttgggtatttctttattagcagtgtgagaacagaataatacatggttcatcctcccagcaacatttcatgggcagagttatcatctactgaaggctgggttgtttggtaagaagaagacaggcaaacctgaatccagtcttcagctctgtcatttaataggtggtggggggacactaggcaaagaacttagtttttataaaatgaaaatggtaacatttacctcacgtaaggattaagggagaaacacagggcttagcagactacttgacatatagtctataaatggtaagaagagaggagatgaggcagagaagaaagagagcagaagggagggagaggtttctttatattcatagtactgggtacctatcagtggctgaataaatgtttattgaattactcctggccaaatatttgatgcagaaaaggtgctgcttccatgtatgtgtcatactccctgagatgatgagaatgacattttacctttctgatattctttccccaaacccataaccctaatttaatcatgataaaacatagtacaagcccaaattgagggaaagtctataaaatacctgaccggtactcctcaaacctgttacggtaatgaaaaccataggaagagactgagaaaccatcacagatgagaagagacaaaggagctatgagaaatacacacaaaatgtggtttcctggactgaaaagggccattaatggaaaaactgatggaatcagaataaagtctgcagtttaattaaccgtttggtaccagtggtttgttttgtgttttttgtttgtttgttgtttttctttttttttggagatggagtctcactctgtcacccaggctggagtgcagtggcttgatctcggctcactgcaacttctgcctcccggcttcaatcgattctcctgcctcagcctcccaagtagctgggactacaggcgcccaccaccatgcccggctaattttttttttttttttttgtattttagtagagacagggattcaccttgttgcccaagctggtctcgaactcctgacctcgggcaatccaccaacctcggcttctcaaagtgctaggattacaggtgtgagccaccgtgcgcagccccagtgttgtttctttagttttgatgtgtaccatagcaatgtcaggtgttggcattaaggaagtatgggcaaacggtatcttggaaatctctgtatagtcttttcaacctctcggtaaaactaaagttattccaagataaagagttggagagaaacacggagtgacagactattttacccagaggattccacgaaggcaaatgagttttcaaattctttcacctctaggcatattctccagctccaccatgatgtggtcttagctttccctaccatgaggacaatttagagacaacctaaagacagctgtaacttcctctagtctggtcccaattgcaagtcacaggaagggctggaagaagcattcctggatctctaccgggctcagatgagattttcttgacaggcatccagctaagacatttggggaaaacactaagcaggctgagagaagcttctctgatcaccacagcctgggctggaccatagaccttggaaaggaaagcagagcttaactttcagatggagttaaatttggtaaccactcaatgattaaattctattcgttatggatgaggcatttcccagtgtcattcaaactatttaaaaggataaaccacacaagggaggggaagaatctataaagggggcattatgaggcttttccacaccatctatgtgcctgagcacttgtggtcctccctgaaccaacatcatcttatcattaagccacaacagcatggagcaagtgacgatcttcagtggctgaaggatttggacatgcaagatacactcatacagttttagcagaaaagacaaaaccatctacagcatcaccgcaggagtatattttgttgaaaagaaaaccatcattgaccctaaaaggcaccagtatctacccagttactcaagtcagcaacccaagaatcatggtttgctcttcttcaacatgctacaagtttccaaatcctgtgattcattcatttacttattcactcattcagcacatatgcagtgagggcctactctgttcaagacattgaattaggcgctaggagttcggtagggaataagacagattctcttctttcaatgagaagccctagacattgatgggcgtataaatcaaatagtcacatggataactttgccaagtgctacaccagggagatacaaggtgatatgagtattgagaacagagacctgacctgcaccagaggaggtgaggggtggaatcagggaaggcatccccaaggaagtggcatttaacgctaatctgtggatgataagcagataaactgaacaagggtggaggaggaggttcttcatgaaaagtggtagtgggctgggcgtggtggcttacgcctgtaatcccaacactttgggaggccgaggcgggcagatcacgaggtcaggagttcgagaccatcctggccaacacggtgaaacccagtctctactacaaatacaaaaattagctgggcatggtggcgtgtgcctgtaatcccagctactagggaggctgaggcaggagaactgcttgaaccagggagtcggaggttgcagtgagccgggatcacaccattgcactccggcctggtgacaaagtgagactctgtctcaaaaaaaaaagaaaaagaaaaaaaagaaaaatgaaagtgggaataggctttcatgagaggtgaggggggcttcattagaagtggaggtgggctgggctttcatgagacgtggaatgggggtaggccttcatacaaagaattccggacaggagggcgtttcttacatcacctaactctccgtcttccattcactgctgttttacttctggccccagtatctctccccaggtgattgcagcagctattcaacaggcttcctcattagtttcctctccttattcttttcactccttacttgcaaccagaatggttctccacacataccaatctgttcttgtcacttcctgttgcgaatccacagcggctcccattgttctcaggacaagttcagtccccttagcttctggacacacacggctctcattatctaggcccttgccttcctttctctttctctctctctctgtccacttttcctctatttctccttacttcagtaataccgaaggacttgcagcctctgtaaggtgtgtggcccttgcctgttctatagaagctttgtagtctgcttctgtggacagaattgctgcttataagcagctgcccagccagagactgcattttcaaaccatcctccctgccccctgccctagtacctagcagggcccatgcatctgagtttggaccaacgaaacatggacagaggtatgcgatgcacatcacttccaggcctgccccgtcctgtgagatcctctatgatctctctttctttctccccagttttctggtaggtgttgaagtcaacctgggaagcccgtgttaaagattacagaggcttcatcggcctgggaccctgaataactccactctcttctcctatcccccgtctctatccagtccctgcatttgagctttatgtgagcaagggagaaaaaaaaaagaagcttctcttatcttaaatcactaagattccaggcccttgacatcacctaccatgtgttaggcttttctgcatcccagactgcatcctcctcatcccttcattttcctaagattaatggcctgggccctggagtcagtctatgtccaaagcttaccaccgcgagcaaaatacttctcagtttgctcattcacgtcatcggaataataacaatgcatttattcctcagagggtctctgtgtatgttaaatgagctgatgcttgggagacactaaacataggaccaggcataaagtaagtgttagctatctttattattgttattgttattactgttaagtgttggtttgcttttgtttttttaatttcattcccccaaacctataagcccctccatcaaagcaactggttctttttctttttgtgtctggttcctgccacgtcgtaaatgcagtaaatacttgtgaatcaaaaagctgtcacaagccaattttttctatattctagaagagttatttgctgaactaaggagagccctgccaactgagttaatcccagggggaggaaaaatcattcccagtgatcttgtaaatttaaatctattaagcagtctttggggttctttctcatgctatccaacagtctgaatagtctttccagattttttggctgcctctggtatgtaatattcattaaatgaggtccccttttcatggcccctgtggctgtcccagcatcactccatccatcatcccatggtccagctgtgctgagtccacttccttcaaggccccaactagcaggcaatgcatgggatctcagagctagaagggaattaagacatacactcacttttgtcagtcaagtactgtgtactagactcttcaaacatgctgttcatggctgggtgtggtcgctcacacctgtaatcccaacactttaggaggccaaagcaggtggatcacctgaggtcaggagttcaaaaccagcctggccaacatggtgaaaccccatctctactaaaaatacaaaaattagccaggcgtggtggtggatgcctgtaatcccagctactcaggaggctgaggcaagagaatcacttgaaccccggaggcggaggtcacagtgagccaagatcatgcctttgcactccagcctgggcaacaagagcaaaactctgtctcaagaaaaaaaaaaaaatgctgttcatttaaccctcctaaaatcctccctgttgaatagtatgtgacagagaagagaacagagtatgagctctaaagtcagactccttgggtttagtcccagctccatcttcctaaccacactaagactcagtttcttcatctgtatagtggaggtgatgttagtgccagccttaggtattacttgtgaacttggggcagtgcttggcacatgactgaacacccactgatttctgagactaagagtttcagtgttattttctaggctataatgttaattatagtcagaggatccaatttgaactcaaatatagagagctagggacccccgattcagtgctcttgacactataccacacagtggcctcagaaacacctgcacctcgctcattttttctgcctgtcccaccgtgagccccaggataagggagatttcactatggccagatacctggtccccagggtcctgcaataatgggaaacagaagccctgaaaatttaaagagaactaaatggctttatcatgtctttcatgaataatcaaagcgatgaggattaactgcatctgcacatcagcaggaagggctatggctggggactcactggaatgattaagaccctctttccctaactgctgaccctgggaaacaggcctttgccttccaaaatgtcagagacatttctgagatatgttgtggaacgagggccccgcctccttgctcccagaaatctctaatgccaacagcacatgactggattcctcatagcagcaaaatgccttaggttaaaaatatgtaaatatatagatctaaaaacacctcttccaatccacgtctattgctgaaaaagcatcactcattctttattttaattgtttttatctccttgaccgtaaatcatgattgactcaaatgaactaactttattataaatatcgtataggtgaatttggcctctgtgacagatttatttatgcaatattagttgaataaatatataagctcaggaagacagaagagctaaagtagattgagctcaataatttccatacattgtctataagatactatcgcacctcattttaacagaggaaactgagacacagagaggttaagtaacttattccaggtcacacagcttatagagaggaagagctggcatgtgcactctctttgaatacagagcccatgtgtttaagtgctaggctgggctgacaggtaggcagtgctgaaagaagccctgcctctgcctagagtgagatggaagggatttcactccacgggttttgttggtcgactttgcctccgtgagttaaggattgcctgggttttcccaggagctgaggaagaggggaggatctttagttgacacagctgatttctcaaggggtcaggcagatttggtgcctggagctaccttgatgttaactatctggctgaaattaaaccccaggctcccatgttcataaattaaacctcaggctgctgtgtccataaattaaacttcaagctgctgcatctatgaaattaaacctcaggctcctgtgtccatgaaattaaacctcaggctgctgtgttcgtgaaggcagggatggtgtgaacccttcatcccctgtatcccaaccactgatctcagtacccagcacattggtgctgcttcggaaatatttgtagaagaaatgaaagaatcaagggaaagaagacagaaaagggccaaaaccagcagtatgtacattataaaaatggtatgaaacttaagggtccagattctggagtcagagctggttttcatgccagcttctctggtttccaggtgacagagcttgagcaagtactttaacttccttggactttgtttcttcctctataaagaacaggtctaatacgtattgtatccttattatatggcattttaaaaagggggtcttgtaatggacttagatgctccctggcacatagaaaattcaaatgttagctgctattattcctattatatcattattatcactgtctcattagacaatattacccagcgatactttggcatttacagccagaagcaaacaggttaggttgacggttgaaacctagagcgaggggcaaagaaagccgatctcatctcccttggtctatcttccctgacagccgctgctccatgctctatgaactggtgagattgtctcaagcccccttccaaacatcgctttccttgaccacatatgaaataattagactttagggaaaatttagctctatagttctggccccttggatacatgctgagaactccaaacacagggactactcttggccgggtttatatgactctggggacccatccactttcccagtgacatacccaaaaggccacagttgcttttcagattattattgcctttattaagaagaaaaatcagttcagttgggaaagggaggtgtgtagcaagaagcagcctcgttgcctttgaggcgcgtggtctctgttctcactgacacccaccaggatgttggccctggccccccatcacccaggctggccactggtcactctgattgtgttcattttgcagctcatgtcatggcaaatttggcagtttcccttttccttgcactcacccccctgctctcaacatgcctgggcgtccgactccacgacaggatagagagattaaatttgagcactccctgcccctcacacaagctatgtccctctccccaccgcaacaaactgatctatacttcctgtctccttccctttccctcctcctttccctccctgcctctctgttcctttgtctttctgtccatttccatctctctttccttttttttcactctttttctgtctcccttcctctcttttccgtttccttctctccttccttcctttcttctttttctctctctcatttctttccttcttcttttccttctctctttctctccttcctcccttcctccttctctttctcccctttattctttctctccaccccccacccccatctctttctttcagcatctgtcaagtacaagccctgggggtaactgtgttggtctctgggtattccatagtgagcaaactcaggtctcatcccatattcctgaagcctgcagtcctgtggatatgatatagacttacaaagaggcgcattagtcatcgatggcagtggtaattggtactagagggaggagtaaaagctgccgcagaacatgaggacgtaagtgcctggtctagaggacccaagatgactgtgctcagggactaaactgaggactgatgtctgaaggagggggagggaatgagaggtgaagggaatgaagggggaaaggatacagtgttttaagaatgggcaacaacacggccgggcgcgatggctcacgcctgtaatcctagcactttgggaggccgagacgggcagatcacgaggtcaggagatggagaccatcctggccaacacggtgaaaccctgtctctactaaaaatacaaaaaaatcagctgggcgtggtggtgggcacctgtagttccagctactcaggaggctgaggcaggagaatggtgtgaacctgggaggcagagcttgcagtgagccgaaatcgcgccactgcactccagcctgggcgacagagagatactccatatcaaaaaaaaaaaaaaaaaaaaaaaaaaaaaaaaaaagaatgggcaagaacatgagacctgggcatttgacaaactgaccagagtatgacaagtgagaaggagaatagagaaagaaatgacagtaagtgattgggtggtacacaaccttggggcgggatcagcaatctatcttgtcatgggccctccaggagactctaatgcatgctcaaggttgagaaccactgatgcagagcacttagaacagaacctgatgctcagcagttcaataagaattaaatatcaccctcattgcatggaggtgctttagaacatgcaaagcacattaaatatggatttaaagaatgtattgatcttcaatgtcaaccctgaatgagtgtatggtcatttatgtctatgatggcatagagttgagagtctttggggtgagactgacctatatttgcatcttagcttccgcaccttgctgggtgatcttaatcaagctgcttcatctaagactcagtttcctcatgtgtaaaattggcaaaacacctcccctcctaaggttgctgtgaagtttaatgagataatctatggaatcgttagctctccaagagagcctgcagtgagtggtggctgtgattatgccaatatcatgccctgcatcagagataagaggtaacagaatcattaccttgtacacgttttagtgtttgctcataaaagcaaatgggcagtccagcatattaggtggggaggcagggaggcaggtagtcagggaagttctcataaaagggcacacgtgaatggttatttcgaaatctttcaaaaccaaacctatgacctcttccccttttaaacatctctgtatgctggcccagctggtggaagggctgacctctctctgtagcataaagctagtagttagagtatcaggagcattccattcttgttgtaaaataacaagaaaaacaaccgataaagagtatctagatgctattcatcttcttcagtttcttttttattttgtatccataaaatctgtctggtattcagatctgtgctcctcatcctaggaacactcatttcgttttgcatgtcaggagaaaatactacagaccagttgtatttgtaaaatacacagcaacttagtgatgaatatgtttactcccgtggtaggacaatgcagtggttagggctctggacttggcagatacgtgtttgattcctggcccagctatttgatgattgtgagacctggggcacattccttcacctctcgaagtctcagcttgctcatttgtaaacactcatttaatgcatagggtctagaatgtaatgcatacttagctatttttaactgtggtattggaaatcatcttattacacaatccagcatggatttcagaaggcaaatattcaaattacataaacatgcttgttatacactttttcactcctcttcatcttaagggttatggtaactttagcttcaaaccttaagcaagctacatggatttaaaagttaactattaaatcaaatggccttgtatgcaccaataacatgtcatttttttgtttgtttgaggcagagtcttgctgtgttgcctggactagagtgcagtagtgcaatcggggctcactgcagtctcaactttctgggctcaaacaatcctcccacctcagtctcccaagtaactgagactacaggctcatgccaccatacccagctaatgtttaaaaactttttggtgagatgggaactcactatttggtccaggctggttttgaactcctgggctcatgcagtcctcctgccttggtctcccaaagtgctaggattacaggcatgagccgccacacctggccaataacacattttttatgagcattgagaaatgttcatatataactctctcatcgggcaggaatgcctgggtgtatttcctccttgttgacccattacacatgacagattgtcaccctcctaatggtagtcatgggacactggaagcgtaaattactaccacctcttctgtctcacaaatgtcagactttgtccacggtacaggaatgtcctctatgtcaaagagctgacaattccatcaccctgtctcctggaaactgctttttagagtgggcttcattgttctgacaaagggagaaaggtgggggcttcctacatgattgaaaaagcctggaaactatttcctctggagatgatcgtcctgagctctacatgggggtggaacatggtggcaaaatgcgagtctcaactggtgcaaggaaaagcctggatttcactttttctgaaagacttagtggtgtctaagcctttatccatcaggagaagctaccaagggctttctttttttctttttcttttttttttgagacagagtctcgctctgttgcccaggctgtagtgcagtggcacgatcttggctcatggcaagctccacctcccgggttcacgccattctcctgcctcagcctcccgagtagctggaactacaggcacccgccaccacgcctggctaattttttgtgtttttagtagagacggggtttcaccatgttagccaggatggtctcaatctcctgacctggtgatctgcctgccttggcctcccaaagtgctgggattacaggcgtgagccaccgcgcccagtctaccaagggctttcaaaaccagtctggttgctcttttccaaggagaaagtctaaaaactctttctgggccctgatgaacctgagagccattggaaacacactcctgtagatctatagatgggtgcccactcagtgtctggccctgtacaaggccctgcagagacgaaatgggtaagacacagtgcttgcattgagagggctcccagttccctggaggagaccaacgagcaaccaaatatgtgcatggagtgtggagtctgcaatgacagaaccaacgaaagtaattcacaggaaaaaaatgattaattcctgtgcggagtgggggaatgataggttagcagagttcttaaataggagttttctaggtagccaagaaacatggcacaaaagcccaggagaacatgatactttgagagagctgtaagaatcgggtatggccaaagccaggggtaggtagtgataagtgacacaggcagccagaaataaatcacgagggccctggttcttactgtaatgtcagtttcctaaaacacctctgctctctctactcccagccccactaattgagttttattcacaactccttggatggataaactgatggatgaatgaattccaagataataccaagtagcaatttttcaaattttaccatgtaaatttgtatgcataatatgtatgtaaaattaaacaaggaaatgtatttttccccgttccatttttgacaagcatgctgctcagtgccttgcattcgttattttatttctgctcacaactctgtgaggtatagcgtattctcatcaactcattttgagatttaagaactcagaatttactgaaataaagccagtcacccaaagtcacaagattggcaaagacagaggtacaattcacactcagataggtccttctcaaatcctgtgttttaagccacaaagataggtcaggaaatgagaaaggggacagcaggtacgggtctacccatctgctcattgcctctgcccactcaactattgtgggagcatcaaggtgaccttgctatgggctgttttttcaatggtttatagggtcatgttggcctccgagaagccagctgggcagtgggagggcaggggtgaagctcatggggctggcagggtggtaaggatgcaccaggatgccccaacttaaagaggtgggcacattactcccagatctccagagccccaacagaaggttgacccccaggagagatgctggatttagcaaatacaaattttatctggcaaaccttacttcccaggaacccctgagttctcctacagaaagttctaaacattccagggaattaattacaccagtgaggctgaaagccaggatttgagttgattaggagacacgtccagtcaggaatgcattaagaacgggaaatattttaagcctcaagagcagcagctaaaaggagccctgttctctagagcccatccccacgatgagaaaaaggctgtattcagtgcagacctggaccccccttcacagggccaaacagaggccagtctactccctgtccctgatacaaactggtccctgataaaaactggtctaatatttgcatacaacctatgctcactcagggtccctccccagccatgcgaccccacagcatggggagacaattagacccagaggtctgggcttgtggaggaggaccagcagagagaccaacctgcctctgccttcctctgccagggagagcaggagacaggtggtggaccttcttgggtcacccagcagatctttactgagcatgtactatgagccaggtggcatgctaggtatctggaatacaatggcaaacaaaatagtcactgtcctcaaggaccatctgtaagggagaaaggcacatagctatacagcaaatatatacacacacacacatatacatattatacatatagtatgtgtgtgtaaataagatatagccagcccttatattatgggtttcatatctgtggatccaaccaaccacaggtcaaaaatattttttgaaaatggatacttgcatctgtactaaacaggtacagactttttccttgtgattattccctaaacaatatagtataacagcttgtgtacatagcatttacattgtgctaagtattataagtaatctagagatgatttaaagtatacaggaagatgggcataggttatatgtaattattacaccagtttattttttatttttttttattttttctgagatggagtcttgctctgtcacccagactggagtgcagtggcgctatctcagctccctgcaacctccgcctcccaggttcaagtgattctccccccttagcctcccaagtaggtgggactacaggtgcccaccaccacgcctggctactttttgtatttttattagaaacgaggtttccccatgttggccgagctggtctcaaactcctgacctcaggtgatccagccgtcttagcgtctgaaagtgctgggattacaggcgtgagccaccacatctgcactaccagtttatatcagagacttgaacacctgtagattttggtatctacagagggctcctggaaccaatcacacaaggatactggggatggctatatatacacacaaacatatacacatatacacacacgataaatacgtgtgtgtgcatgtgtatatatatatatgaaaggatcaagatgctatcatagagaatatcaggcagagagacctactgcacattaaatcatcaaagatgtcttcactgagtgggtgacatttaagcagagataaggaggcagttatgtgaaaagcaggaagaaagcactttgcaaagcttttggaaattgcaaacatcccagacaggacttgccatcaagattaagtcattggaagagcattttcttcctagtcacagagcttgcttgctaagatctagcctgctggccattgggctgtgtagcagacacagccatatccccatccctgaggtcggcgctgacagtccccattcacacaggcagatgcccacagctctgcctgaggttgtttcctggtttgcaatttggcccatgttcaggcaggttgcaagagccctgagttaatgccacaggcgcatccctcagcaggtgcgggataagagtgtggcagtatgttcctgagtgtgctctccccctctgtgggacagttaggaggtgtgttctatgtcacctctcagaggggccccactagaatagagctttgttgttcacaggggtaagccactttgtaggctttcctcccttccccgcctcaccaccctaactcgttcatctgacttcctgagacccattccaactaaactatatgcacccacacttttaccctagggtccacttgtggggaaattcaaaccctttgaacaagtctttgatgatcagccaagatgaacacaaacacctctcctcatcatccccttccccagtcgctttctctccagcccagcctgtccgctcatcctctccatgtaattctgcactgtccaaccgtccaccctgagagccagactagctcccctttttcctctgcctggcaagtttctattcaccatttaaatgtcacttccttttggaagcccctcccgctcttctgcctctatgccctctacattatctttctaatattacccttattagattcatctatctgtgcattcatccatctgtccattcgtccatctgtccgtccatccatccagcagctatgccttaactgcctctatatcccaggcactaatgtgtgcaattatcccgggtcttcctgtgctagaggggtcttcttgaaatcagaatgggccttagcatctctgtgcttccaccacatatcacagggtctgggatggagtgggtgcttggcaagtgttggatcaaattaaatggatgaactttgcctatcctatgtaatgataatgaggttcttaattacacagggggaggatacattagtatgtagaattaataagtgagtacattgtcatcaacatgtgagctacatgtagacacagtttcattactgaaaacagcttgtaagccattatgccagtgactgcttgatttcccaataccaaagcagaaacagcccccagcaggttccgcttgatccctcagtgaaccacaatgacagaaattcttgctttgctgccccaaatattttctttagaattttactgaaccctttgacctcacgatttcatactggtagggctgccgtatactgatgaaagacaggatgccaccttcactactggcaatatcttctaaagagataaccagagagttagtcaaacagccagccagtctctatgcaaacattgagcatcagcagttcttccagcaatgagctagacacaaagtatacagtcataggtaagatggacttagactctggcttctgaaacttagaatcaaagatacttatacaaaaatgttcactgaaatacagtttataatactataacaccataatttcttgtcagatagttggttaaaaggaattatggtatatctatataatagaatattccatagtcattcaaaatggggtgttaaataatttgtcattacccacaataatgctcacaatgtaagcttagaaagaaaaagataatcagggtatatagtggtgtattcagtgtgattccaattctgtggataaaaaaaattattgataatacatattagaaaactactgtaacagaataagccaaattatttagagtatctctgagatatggcattgtagttgacatttttatagttttctgtattttccagatttcgtgatttacaatggcataaatgtgttgctttcataataatactttttataaagagcttagtagaggtcagagtaggtccttctgcaaaatgcagcatttcattctctgatgtttaagtgtatcaggagaacttactaaaatgttcagagtttttgctgctcttggagaagtaattgctttcagtcaggccaagagctttttggaaatgagaaagcaggaaaaaaaaaaaaagctcttaaactatgactgatgtgcctttacttcttttgttgattgtgacctgcaaccactaaatagtggccaaaagcagtaggtgtatgagaggaggaagggagacagaaaccaaaataatcacctctcccccggtcttcccgtgcttctgacgtataaacctgtggtcctggaaacgtattgccctcatcctgtgctagctgtgtacttcaaaacttcggcaaagtgcaccaccatattttaacccatgggtgcatttcatttttggtacaactgaatatgcatgtcctgcctgtccatcagagtgtggacatgatagagctcaaaaatgcagtgtgacgtgcaataccacttgctgtgagtactaaattgaggctgttgcctgaggaagatcaccctttcactggaccatgtaagaaattcttcttgtgcacatgcatcaaaagggccaggtcagaccactaagaagttctaaagtcgagtggcaaaaccaagtgtcagtgacagtaagtgtcactgtagagactgtgagatgttgttgtgctgtggttgtgaatggcaatgtaatcttgcctgcatttttagtgttatttgaatttttatcagtcaagtatgctacccaaaaattgtgttatacaaaagtaggctgtcaacaaagaaatatcaagaactgctgatgttcaagtggaaggagatggttctgctgtgccacgtttaagagggttatcaccttccaggccaccgtcccctggacgtagtgccatttgccaaagagaagagttgaagggattaaacatgctcagattggaaaagagaagatccacggtgcaggaacgttgtggaaatatcaacagggagtaagaagggatatgagacatacaaacctatagttttgtgtgtcatgcttcctaagagcaaaatttacaggaaggctgtggacagcatattctaaataagaccttctaacaatcagaggtgcctcaaaatagaacgggctgactagagaggcaattagtgctccatttccacctcattagttttcatcctggaaatattataggaggaagctgagtcaggaagctcctcttgcaccaggtaggaggttggagtggatgactcaaggacattttaggtcctaagagtctccagagctgtgttttcaatgctcgtcacgttgcctctgtcttggccccccatgtgggattgccccatgtgggactatgcctggtccatgatcttgctggagagacaggtaaggagttgaagtccttaccattaatattagctggtaccaggcagggtgttaagcccttactgaggtcatctcctttactccttacacccaccttcaggagacacggttaccatgcacaggggcaaaaacgacaaaaacaaaagttctgaatgcttatgtgatttgcccaacgccagctatccagtaaacgtgatcaggggtacttccgcagatggtctgcctctagaacatgccacctcatgttcccagaacctacccagtatagggcactgttcacagtagcaaaaacttggaacccacccaaatgcccatcaataatagactggataaataaaatgtggcacatatacaccatggaataccatgcagccataaaaaaggatgagttcatgtcctttgcagggacatggatgaagctggaaaccatcattctcagcaaactaacacaggaacagaaaaccaaacaccacatgttctcactcataagtgggtggtgaacaatgagaacacatggatatagggaggggaacatcacacaccagggcctgtcaaggggtggcggactaggggagggatagcattaggagaaatacctaatgtacatgatgggttgatgggtgcagcaaaccaccatggcacgtgtatgcctatgtaacaaacctgcacattctgcacatgtatcccagaacttaaagtataataacaaaaaaaagtaggtgcacagtgcatggcacttaggtacgtggcacataaatgtccactgaatgaaacaagaaacaaatgtgcaaaatttatgagacagagagcataccatgaaaggaacagggcgttgcattactaagatgtcaaaggaggggaaaatgtgaagaaatcatcattcgttcatccattcattcattcatctccatgtttttatgaacaaattctacatgcctggctgtgtaccaggggctccagataagaggtcactgatgacagcagtggtcctagtgataccagtgtttgagcaagggggatggcttggtaaacaatattaacagtgaaataattttactcttactacactcgcaaagaaagccagttaactttgaaagtttgtcattgataggaaacagcgggacatagagctttgaaaagggtcctgtcctacaaagaaggcaggtctgagaatggaaaggtggcaaaggtgaaatgaatagaactaaacatcccagtaggaatttctatctggagacctggccactgcattccagttccctacaagactgacagttaaaacgtactctgatccagaagcctccgatgtcaccttccagctgtgatgggtcctgtcccgcccagaacagaacctcagccgcaggatctgaagtcacagaaagagtcccgatgtctgatctctgaggactggcagaaacggagcaatgatttgagcgtttgagtcattcatgttcagggcaggtactttgaaatggaattgttgatcacatcagaaggtgctgaaaccaaggtcaggctcctgttcctgttgagaggccttgttaatgaggtgcctccagcaaacatggacacgcgtgccaggcaggaaggcaggctgctgagctgtgaacacgatagtcccaagtaaacgcctttgctttctgccaggcactgctgcatgctggtgtacaaatccccgtgtgtagggtacaggcattgtaggagatgggtaaagacaggagtaggggacatgagcttacatctcctaagcccccactttgtgtttgattccgtgtaaggctgtatgcacacttctctgttgtacactcatggtaacctggtgaggtaggtaatatcatcccaactttatagctaaggctatcagttcagagtaaccaggtcaagttccctcaggtgcttagcagtagatccaaggatcagaatccaagtcccactgatgctgcccctctgcccttctctcctggccaccctattaattattttccttgacttaatattaggatgactatatgaccctatttgcctaagacacagtttatgcctgttgatcaaggggaattaataatagcatcccctttcattctcaaaaagagtcccaatttagataataaattatatgggcaccctacacaatagtagtttgagtcgtttggttttttgtttttgtttttgttttcttttggttgaaagagacgcatttatcaaaaccacaacttcaaactgtgggtgcaaattgtaatttggctggaaatgagaatccggcatcccaccatgcaaatacagtcatccaggaaatgtatccaaatgcactacatggaaggcagccagcctggaagtgactctaatactcctgcactccttgatttagagccctgtgaaggggactttgccatctggtggactggacggctccacggttgctggagtccaactctcaaacagtgtgtcagtctgtgggctatgggttgtcctgtggccatgcatggtgcccctcatttggagagtattgctgatgacagacacaagccttgctatggtctctacaagggttgattagcagagttgccatgtgcggttggacaggctgcacactgcacagaaacaccaaactgtggggcaagcaagagatggccacactctagttgctagggctcacagctctgcccggcaacagatactagcccgtctttctaattcacacaaaactgtggtagggtagagcaggggcagctatggttacagattgaacctttccaaccctgccctgccactgacaatcagaaatcccagagggtgtgaaaaaagctatttaacctggaattagtaaaccgaagaccataacatggaatgatacagtctttagagtaagaagagcagagctggccaggcacggtggcttatgcctgtaatcccagtgctttggaaagccgaggtgaaaggattgcttgaggccaggagctcgagaccagcctgggcaacatagtgagaccctgtctctacaaaaaaaattgttttaaattacccagacatggtggcaagtgcctgtagttccagctatatgagaggctgaggtgggaggatcgcttgagaccaagagtttgagtttactgcaagctatgatcatgccactgtacctcagcctgggcaacagattgaaaacctgtattaaaaaaataataataagagagagagagagcagggccctataatctaccgagcatccactatgcttggcactgtactaagtatgctaacctgtttgcatgtgagttcgctgaggctcagagagatgaagtagctttccagagtcacacagcctgtcagtgccatagctaggctgcaaactccggtttgcctgactccaaagtccatattgtcgtgtttccccagtgctgagcgccatcacacaggaccctcggagattctgctcctgtccttcttgtacatttgaggggcgtaagctacagagccctgaaatggcaagagcaggatcagaactcaggttttctgttcctgcgtgttcaaggctcccttcagagctagcttgctttgggtcttgttctgaaagcggggatctcccacagtctcttcctccagggccatactagtgctcctctccccctcccaatctcggggctgcccgtccttattgctcaaacaacaaaactgtgctggcttgaccctcaaacataccatgaggtgaaagtggactgacctctctctctcagctagagcagaggaggggctgtcactggtgtgtcatcccgtaggcccgggctcatggagccacctcctaggagaagctttgggaaagcaaaagtcacctccctcccacccttgatcctgaagctgcctgctgtgctccgtgaggacggggtgtcaggaaacccagctgagggggatctgatcaggcgtctcgggcactggctggcagctgagtttatgtggggagtgggagtcattgttgccagatcacttcacgaacatgtcctgtccccacaggcttagcaataaggccccttgcatttaaacctcaccacttccagttgctagtacttagactttctgagcctcagtttccaatgatcctggcaagattactctaagttcccttgctctttccgagcctttcttccagatggcaatatgatgttgggtggatagaatgagatgtgtgtaaagtacccagcatagtgcttgacaaagcgtaacttaccaggaagaggtggttccccttccttctctccttttggcctacagatccacaactgtcctacagcataaggcagtggttaaattgtggaagctggagtcatactacttggattcagatcttctccctggtattactgtgtgactgtaggctgttacctaacttctctgtgcttcggttcttccatctgggaaatgaggatgaactagtacctacctcataaaggttgtgatgaggatcgaatgagctattatttacagggtatgttgagccctgccaggtacacagtaaactctgtggagctggagttgaatgaatcaacctatatgcttcaccactttgcctcacttgcttcttaatccaggacctttgcaatgagctcagagcagtctaagtagaagaaaaggtttaaattgtcatcttcccagtcacttgctggagcagagctgtgacaggctaggaaaacccggtgcaccgtggccaagcatcaagagcctcagagcctgctaatggggatgggggcttattttctcttcctacttctctgatcacagaagactgtgttggtcatgccctgatctacaggatcccacacactaaacccatggactctgatgtcagcctcaactaggaaaagaggaagtggattgctacaatgccataattgagcaaattagaaggatgcctttatagagcagtggatctcagcgccgtcagcacattagaattctccagggaatgtataattatatacgaatagtcaggccacatccaggttttaaataaaatacctgattatcagatactgtgagcatcatggggcctttctcctctaaatcacagggaatgtgccagtgatttaccatgatgatttatgtcagtgattctcagcttgagctgcatcagaatcccctagagggcctgttcaaactcaggctgcagggccccatcctggaagtttctgattccataagtctgggttggagcctgggaatctgcattacagcaagtccccaggtgatgttgaggctgctggctctggcaccacacactgagaagcacggatccatacaatgaataaaagagaaaaaaataagacactgtccaccaagtcttctcaaagaatatgcctacttcttttggggattaaaaaaaaatgaggccgggcgccgtgactcatacctgtaatcctagcactttgggaggccaaggagagttcaggatttcgagaccagcctggccagcatggtgaaaccccacctttactaaaaatacaaaaattagccaggcatggtggcacgtgcctgtagtcccagctacttgagcagctgaggcaagaaaagctcttgaacccgggaggtggaggttgcagtgagccaagatcgcaccactgcactccagcctgggcaacagagtgagactctgtctcaaacgaaaaaaaaaaaattgcccatacttatattttgagcaattgaaaaatgcctgtcccactcttttccatttttcttccctctctcctatctcagccatgcacccctgtaacctcctgccattgaaattctcggcacctgtgtgtcacagcgcatatcacgtgtaggtcaacagctttgcagtgacaaacaaagaaaaagaaaaactgactgatgcttgaagcattgtaggtgagaacacagaatagtctttgctgcctttggtggcaggtcacatggatcagcccacacagtggagtttgaatttcctcttcttacaacaattgagtcactgaattgttgagcagacaaatgacagcgtgatctgaaaaaaatgtttctgactctgtgtctaaacctcaatgtgggagcttgtattgttgtaagaaaaacgtaagtatggctcatgcatccaatgtacttgattttgtgataattttcagttatttttgctcatctaagtacctctatgcgtcgatgaagatgaaaaaataaactgacaatctttggaagaagaaaatcttacctcaccatctcctccaagtctcttctccgaacattcacaagctcattctgctaattcatttccattctttgactacattaatgatctgtggttttcatgagctgtttaacagtgaaaacaacttttagaagagatatacaaaattctttttgtaagatgatcttgaaaatggtcaagttagtaacagaaagttccattttcatcaaacttggtacagggactcaaccttcatactttttgggagatttctccaaatacactgtttttggcccagctaaataactagtcaatgtgatcaagaaatcttagaactgaagagaccacagagatcattaagtccaagttcccattttaaaaatgtgaaaccgctgggcgtgctgtttcacgcctgtaatcccagcactttgggaggctgaagcaggcagatcacgaggtcaggagtttgagatcagcctggccaatatggtgaaactccgtctctactaaaaatacaaaaattagctgggcatggtgccacgtgcctgcagtcccagctactcaggaggctgaggcaggagaatcgctcgaacccgggaagcagaggttacggtgagccgagatcgtgccactgcactccagcctgggcaacaaagcgagactccatctcagaaaaaaaaaaaaaaaaagtgaaatcaaggcacagagacatgagcttacccctagtcacacaacccatttgagaaacttgaccacaggtgagtcctttccttctccttatctatctcccccgacatgcccacacactccactttaatgcatgcccttcattgtctgcatatgtccaaaaacatagtgcaccaatgcagtcttttgctagtggttcagtggaattggtgctctcattctcatggtttaggaatataattgtactttaatggtttatttattttattaatgtctgtcatcttcattacaatgcaagttccaagacagggaccatatacataaataactcgtttatatttctggcacctctgataatgtttgatccagtagagatgctcattatatagcactgtagtcactcctgtaatcccagcactttgggaagccaaggcgggcggatcacgaggtcaagaaattgagaccatcctggccaacatggtgaaaccccatctctactaaaaatacaaaaattagccgggcatggtggcgggcacctgtagtcccagctgcttgggaggctgaggcagaagaattgcttgaacacaggaggtggaggttgcagtgagctgattgtgccactgctctccagcctggcaacagaggaagactccgtcaaaacaaacaaacaaacaaacaaacaaaaaacactgtagtgatagaatgaatgactcaatgaagtaacagagaggctgagattcaaaggatataaggaataaaccgggagaaaagacaggaaagaggattccaagcagtggggattgtatgtgcaaagatcctacagtgaaagagagggtggcacttaggaagaactgattgtttttccttgtggtcaaggtagagttctggaatacagtgagaaacaaggctggaggagtagacagtatttacattatagacattttcctaagccatccattctctgtccttacttagttgagtttctgatgctaaatcctgaatctcagtgcactggtaggctcatctagcctaaattcccacttaatgggtaaaaagaatttcaactgggccccatcccaatctcaaaactgttatagctaaaaactgctccttactcagtacttaatatgtaccaggcagtgtagtaagcctttaaagagatgaattcactcctctaatcattcgtttacatgctggaatatgatcttgctttaaactgccagtctgtcgatcagggtcatatatttcagggacctaaatcagctcccttgttaccacagtccctggattccctgctgcctgtgctctgattaaggagactccagcagctctgcaataaggattgagttgattaacatctggttgaaaatctcttcgcccatatgaacctgagacaaagccatccaaagagtaattgatggcaaagacccgaagttgtctctaagatggcaactcgagggcttagctgcacagatgagaagattaatagcagagtggccttggagtcacggatacctgcatttgacttccagctttctcattcacatgccaggtaaccttgggaactttccttttctctctgaatccccatgtttacgtatgaaaagaagacacaaatacttacactaaaggtggtttaaggatttaacgaagcaccttagtacagtatctgccccatggtgggacaaaagaagccgcagctgctattaatgctgtattgttagccaaagggaagagaagggcagatgtggtgcagaattcttacgttcaaaagaaggaaggaaaatccattaaaaacaagcgcatgcaaatcgtcatttactgcagtgactgggagaatggattgtcttgttcattttatgttctggttctggaggtaaactgcaaggtcctttttattgaaagttcattctgtcttccacaaatgttattgagtccatgctatttgctaggcacgtaggagaaatgaggataaatgagctgctgatcctgcattcacctcgggagttggagaagggagaatacagattttctataaatgtgtgggaaggcacttttctgcttaaatacagaatgctaagcattatttaaaatttattgaaaatgttaccagggcctctcattgcctaagacaggtgatggagaacagaaaggccgcaagtagatatgtgatgaatttgtgttttccatccattaatctttatataaaagtatagattattatatattatacataatactcacatagcatactaatcttaattgtgttattagtaattctatttctctattacttattaaatagatagtatatattatgtatatataattatacatatacacatcatggctatatatattaattgtacattattctagttataagtcatatatttatccattatctaatactcacatattatatgttatataataatataagtacataagtgatttggattacctatattatctctctcttttttttttttttaaccatgtgcatgtttttctttaaaatagaaatagtgaagttctgcttcagtcagaacctgcataggttaattaaatgcacgctttactccaactctacaacactaaaggacatgaaggctgcaaaacgactgggaagggctgcccccatacactcaactcctccagtttctcatgcatccgtccaccaagttttaccagacatttactatgtgccaggttctgcactgggcacaggagcagagggccggtggagacacagtccctgcccccacagagctcacagatggggcaggcagaagccacagaggccgtggtggtcacgcttcgggagaaaagaaccacaagtcaaaggggcacaaaagggggcaaccaactctatctgggatgctggaaaggattcctggggatggagatgactgagtgggaatagccctgattggaagaagaaagaggaagggagggcataatgagaagggggaaagcatgtggggaaactggcgttgatgctaaaatagcatagtcacgcaggatctgatagcaggatagcagatatgctgctactgcaaatgtaataagaccaagaaaaatagtaagagaggacttaggagtagtgatagcaagtatgtattgagcattgattgttctaggcactttgatgcattatatcacgtaatctcacagtaaacctagactgtgtagagtattgctaaccaaatattttagacgagtgaacagaggtgccaatacgttgctcagctggtatgtgtggcagccaggagtgaagcagatcaagctgttactctagtggtgttggagcagacatctaacctctgtaaacctcagcttcttcctcagtaaaataaggtgacgctgggcacagtggctcatgcctgtaatcctagtggtttgggaagccaagattgattacttgaggccaggaattctagaccagcctgggtaacatagtgagaccccatctttacaaaaaaaaattttaaaaaggctgggcttggtggctcacacctgtaatcccagcactttgggaggccgaggcgggcgggtcacctgaggtcaggagttcgagaccagcctgaccaacatggagaaaccccgtctctactaaaaatacaaaattagccaggcatggtggcacatgcctgtaatcccagctaccctggaggctgaggcaggagaatcgcttgaacacaggaggcagaggttgtggtgagctaagatcgtgctgctgcatttcagcctgggcaacaagagcgaaactccatctcaaaaaaaaaaaaaaactatttgggtgtggtggcatgtacctgtagtcccagctactggggaggctgacgcaggaggatcacttgagcccaggagttcaaggttgcagtgagccatgattgaaccactacactccaacctgacagagtgagaccctgtctctaataacaaacaaaagtaagatgaaaggtcattctgagaatgccagggttgagggctgcacaatgccatgctcatggcaaatgctaactgtggtggctgaagttcggtgtgtgttagggagtagaaattggaaaagcggaggaaataagtgaatgaggggagactgggtcagataataggggccagtctagtgtgataaactagatgtgtgcattttattctgaaagctgtgatggacattgggaagtccaaaataaatagtgacatgttcagtgttgtgtttgagaaatgtcactctgaccacagaaggacttttggaaacagccaggtcaggtggaggagtgttgtcatagtccagggtgagaaatgtgatgatccagactaagaagagacagttataagagctgtcgaggacaaagagataacacagtttctgaatatagggacgtggggttgagggaggaagaggaggccaggatgctgcccagattcctggctttaacgctggggaatggtgcagtccatccactgaagcaggaaacacagtaagaggagtgttaaattgcatcccacccccaccactccaaattcatatgttgaagccctaacccccagtacctcacaacgtcactttatttggagatagggtctttacaaaggcaatcgagttaaattgaggtcactggagtgggccctcatccaatatggctggtgtccttatgagaaggggaaattcggacacagagtgtcatagagagaagacggcgtggagagacgcagggagaataggcacatctacaagccgaggagaaaggcctggaatagatctttcgctcacatccctcagaaggaaccaaccctgccaacaccttgattttagactttgagcctccagaactgtgagaaaaggaatttctgatgtttaagccactgggtcagtagaactttgttacagcagcactaggaaactgacttagggagtaactcattcagagatggccacgagttaggttttggatcagttgagtgtgatgtgtcgcttttgggacagccaggtggagacaaatgccaaaacgatagagacccaagtccaggactcagtgggcagcttgggaccggagattaacacatgccaatcattttggacactctggcattcatagcacagtgcaaccagtacagaatagaaatttgaaaaatagttgaatgaataaatgaatatcctatttgcctaaggacagagggcgaagggaatacagggagactggaactaattgtaatttcccatcccagtagtaagaaggttatctcaagcgctgtccataaggagctataactatgacatatctgaggccagcaaattttagagaattgctgcattggttgctgatatttaccctccctagaaaagatagtcctctctttgctttataaaatctagaaggcaggagaattaaacaagtatcaatgctattcttaggacagaaaactatagcctgtccagagtctcaggttcatgcccatattctgaaatgttgacctccaagggagtgtgccagcaacatgtctattttaggtaggaagtttaaagcctgctttgcttaaaatgtcaaaataagtagacagcataacaatggaaagtggtaataagtggaaaccaggagaccttactttgaatcccagatttgcctctgaaaaagtgggtaaccttaacctttctgaatgtcttttcctttatctatagagcagtcaggggagggggtaattggatgatcttccaactctgacattctgtgattctctcagtgttgcctttaattgcaacgggtgataagatgacatttccataaattgacctgccaacctgatttagtccgccagcatgaagacatgaaaataagatgataggcagaaattaacatcacagatgacgctggtagaatattttccctccttaaaatggcagatggaacaccagaaagagacaacacttggctttagaatgcaccttagttaccagaaaactgggttttactggaaaatgcctgaatatacatgaccacaacattttgtccaatgacttcaagtttgaccatactgaaaaacgatatggaaaaataaacctgctcctaactgcatttgtgatttcccctggaccacttaatatttaaaacttgtgttgacctcttctctatatgcctggacatctcggcaatggatataataagcccctaagggggaaaggtaattaggatttattatctaagtgtcacattttgtgccaggtctttgacctgtgttgcaaaataccttatttacacttccctgtagaagatgctgtcagccacatcctatcttttctgcacttaacatgccgaaggttgcttaggacttctgtctgctgtgggagcccacttgactggaagaagccagataggcacaagaattactattgcagaagcagccctcaacaagtatcagatgcaaatgtgctggataaatactccggcttccttgctcatggttgggataactcagaggcgtattctacacttgctcacagggttccccagagggattgagctccagttacacatggtagatatggccttgataacacatcttttattggctgccttcttttactgtcttaataccttgttatttccggagatcattgtccaggtaaaatacctacatccaaatcgttatcttaggttcggcttctggggtacccaaactaagacatctgcaagagcgctgtgaagtaggtggcattgtaagatatcagtttttaagtcttggtgcttggattcgcctgattcccattgactttcctctatgccagtgattcttaaccacaggacattttgtccttccaccaaggcgacactttgcaatgtctggatacatttgtggttgtcacaactgggaggatgctactggcatgtagtaggtagaggcctggagggctaaacatctgacaatgcatagtacagtctcctaccacaaagactaatccaaccttaaaaaggccccccgggcacagtggcttgcgcctgtaatcctagcactttaggaggctgaggcgggtggattacctgagctcaggagttcgagaccagcctgggcaacacggtgaaaccccatctctacgaaaaatacaaaaaattaaccgggcatggcagcatgtgcctgtagtcccagctacttgggaggctgaggcaggagaatcgctagaacacaggaggtagaggttgcagtgagccgagatcgcaccactgcacattgcactccagcctgagtgacagagtgagactccatctctaaaaaaaaaaaaaaaaaaaaaaaagtcaatagtgccgatggagaaatcctgctctacacccagcaagactggctatgatctggtggctcctatgtgtgacatagctattgtcttttccttccagggtcaagctgtggctcagctgtgttccactgtccccaacgtgactgtctttggaacagcctctactttcaagcatgaagcaatcaaagactctgtgacccacctctttgacagaaatgcagactacgtgcaagaagttaaaaggtaagatgtttgcttttgaaaaagcaccaggctggcccttgctctgctctcaaagagcagtagcacttatttaaaagagggataataataatatgtagcaaacatatattgggggcttagtattattagctctgtgccaaatatttcacacgcattagttcatttaatcctcttaacctcactattatcaccaaggaacgaatcggctaacttggaaagttaatgtattaaagttacgctagctcctatttgaccatcttaacacatggaagtttatttctcattcattcacatgatagcttaaggtggatatttggtggatgatcttctgtaagagcattcagagacccaggctcttttcatcttatggttccactattgtcttgggtctaaaggtcctttgcttctagccaacagatgggcagacagcaccaaagggtcatgaataggaggttttatgggccagtcccagaaagaacacacacccttctcatagtctagcactactgctcaggtcgttggctacgccttactgaaagcaaactgagaaaccttgtcattgggtgcacccagaaaggcctggcactggcagtaaagggtggagcctggagtcaagccaggcatttcaacttcggagcccgtgattttcctgtatagatagcacctctctgaacagtgaagcatgagccagaattatccataggaagaaaggggcagggagggggctgctctgggaaaggaaagtcgtgtgcatgcatactgaggaatgcaagagcctcagaggctgggagaactacaagaaggcttactggggtgcaagtccagggatgtcttgttatctcatctaattataggtgttggcaaagggacacctggggggaaagggaagaaggggcatgaggtgaggctgagcaaggagacaggtatcagatgcacataaagaccatgtacaccaatccagcaaatgtggactccaacctgggtgtgaccaagagccactgacagactaaaatggggctatgattgatttgagttttgaacaatcactggtggtgcagaggggatggatgggtagagggaggctggggctgcaagatcatttgctggctgttgcagtcacctgggggaatgatggtttataacctgtgattctgaagttattgatcatggccacatgtttgtcagcacagggaagcagatggaaacccagctgccatcatggttttagatgattttgtgtgtctcactctggctattgctctgggccccaggcttgttctcagggtccatgccactcagagcttccgagaggattcagatttgggccagagccattgtttcggcattctcattttccaacacaaaattgttacgtacaaaggtattacgttgtccagatagaatcataataaagaaacaaggctgggcacagtggctcatgcctataatcccagcactttgggaggccaaggagggcagatcacttgagcccaggagtttgagaccaccctggccaacatagtgaagctcgatctctacctgtgcccccccacaaaaatacaaaacgtagatgagcatggtgatgcatgcctgtagtctcagctactcagaaggctgaggtgggtggatcgcttgatcccgagaggtagaggttgcagtgagctgagatcatgccactgcactccagcatgggtgacagacagcaagagcctgtctcaaaagggaaacaattttcttcaaatcacagattaagatgggaaaactgaaggacaagtggatgggagagctggttatttgaggtgatagttttagaacagatttggtgaaacttgggaagtttcttgaaaaggagggggttctgatggtcttagttttcagatttatttttcaattttgaatgcagagcattgcatataatttaaggttgtcccaatagttccagcaggatgtgaaaggaaagcttaaagctagatgttagaagttgaccctctgtttctcagatgtctagaggctgcaggctaattttgaggacatccatttgcccagttccatagctctcaggtaattcttcttatccttttttttttttttttttttttttgagacggagtctcgctctgtcacccaggctggagtgcggtggtgcaatctcggctcattgcaagctccacctcctgggttcacgccattctcctgcctcagcctcccgagtagctgggactacaggcacccaccaccacacctggctaattttttgtatttttagtagagacggggtttcaccatgttagccaggattgtcttgatctcctgacctcgtgatgcgcccatcttggcctcccaaagtgctggtattacaggtgtgactgcgcccggtcagttcttcctatctttaacttgactctcttaagctgtggtctggaaaatgaactatcgttgtcccttcagtcattgtttctttgacttccttacgtgtatttttgcaagcattctttcatgtacgcatgaatacaattgcttaatacatctgtgctttgtgtctgtgatggcctggagactgtgccagagccagagatccagcaatgccatcttgagagccactgtccttgtggaatatagagtcttaacggagggagaggggacaaaaaataaaactataaagagaaataactgattcacattttcgacatgtgctctggtagtgaaatgcaaggtgctatcgaatacttactgatggagaaatcagaaacactgtcaatcgcagagtgggattttggctgagaattgagggatgagaagttggccaaaggaagagcatttctgactagcagggatgccatgggctaggatcccacatcaggaaaagcttgctgaacttatgaacctgaaaggaggccagtgcagctggcaggatgtggggagtgggaagagaagggagatggcatctcttctgaaaaagtaatagcccataaccagagaactcctgcctgctccatttcctcagcatccttcccatcctctatctttccactgccctagatctactctcttagcccccacatcactggtgtctgctgatgtcagaagaacagaaggcatttgagacccacctcaccctcaccttccttcaaaggtgacttcccacaattcattgtgtttttaaatagagaccttgggattacactcagaatgcccaggaagttacagatacgtttacacaaccctccgtcctagcaaacctaccctcaggaaataagaagagcaaagctacaggtacaaggctgcctgttgcagagccaaaccctgcttctgcttcattgtaagtgctcagcacatgttgacagagtgaattatagcattgtctgcaatagtgaaaattcagaacaagcccctacaatcaacagaagggaaatagttcagtcgattatgccacacccacatacttgagtattgggcagtcccttaaaaaatgataattatgaagacagccacaaaatgaaaaaaatgcccatggtagcacattgcgtgaaaaaagcagaatgccagattccatctactctgtgatcacagctttgtacaaattctcggtgcatgtagacttaaaatgaaaggaaagggaaaatatccaactgccaacatgcgataggagtggaatgcagagtgatttctctttattttttgatcacagatattgttacgctattaggtgtacaatgaaccagaaaaaaaaaaaaagataaaatttcttgagatgaaaactcttttataagccagtcaatcgggaagcctcctttgaacacattctcagccttgaggcaggtgttgtaaagggaatagaaaaaaaaatatttatgacacagacctaacctttacatccgttactttctctctctttaggaggagagagatgattatgagtgaaaccaagccaaagcgttagaaaccttgagttgtgtgtacctaactgcaagggctttacaaataaggaaaagagaaagatcagagagagcacgtcaagatggacagcccctcaggtgcacttgaaggttgcgatcgatttcagtaggtggagggggaagcgtgagagaatccacacaagggaatcttggacagaacagggcagataataatagccacgctttgttgctctcctgccatcctgctacgagttcaattagaccattttctgtgcacctgagacaatcctgcaaggtgaacattcctcattttacagataaggaaattgagaggtaggaacagatttggccttggaggtgtgtgagtctgtcagctttctattctgcaaaactcctcttggtttacaagaggactcaaggaaacttttgggcgtgaagcatatgttcattacgtggacggtgatgagggtttcacaggtgtgaacatatttaatctctcaccaaattgtacactttaaatatgtacagtttactgtatgtcaattatatctcaataaagctattaaaaaaacctgcctttaaaaaaatcaaacaacattttaaaacttcattgggtggaaatgggtacacaatatcatctcagaccttttgttcattcattcattcattcattcattcatgtagagatgcttctcgacttacaatggagttacatccctgtaaacccattagaaacttaaaatatcatgagtcaaaaatatatttaaggccaggctttggtggctcatgcctgtaaatccaggactttagggaggccgaggcaggaggatcacctgaggtcaggagttcaagaccagcctggccaacatggtgaaaccccgtctctactaaaaatacaaaacttagccaggtgaggtggtgcacacctgtaatcccagctactcaggtggctgagacaggagaattgcttgaacccaggaggtggaggttgcagtgagcccagattatgccactgcactccagcctgggcgacagagcgagactatcttaaaaaaaaaaaaaaagaaagaaagaaaacccacaaaacacaacatttcaaaacattgggtgggaaatgggtacacaatattatttcagaccttttgttttttcatttattctgtacagatgcttctcaacttaaagtggagttacatccttgtaaactcatcataagcttaaaatatcatgagtcaaaaatgtatttaatacacctaacctactgaatgtcatagcttagcttagcctaccctaaatttacattagcctacagttgggcaaaataaactaacacaaagcctattttacaataaagtgttgaaaacctcgagttgtatgcagtcaggtatacacaactcaggattcttaatgcttaccaaatactgtactgaaagtgagaaactgaacagttgtatgggtacatcacaaagttgaaaaattatgaagtgagaccattgtaaatggagtaccatctatattagtgaggcctacaaacagactacgaagatacaatggtgagcaaaacaagcaaatccccatgcaagacaatggggttggcagctgatagggaagtacagagcactgtgggggcacaggtgagcaatgcctaaatggaagcctgaagaacacatgggagctctcttttgggtcttccacattgtatgaagtaaatactgtgcttatttttcagagggaggcaaggcaagcctagttaagtaaatatcacacaaatagacgtgacgggactcagttccaggtggctgtagtgccagagcttgtgatctttctagcacccacactgactctcacaaaggaagtgagggcggcttgctcctcagccagggaggaagccagattgcctgtattaaagcatgtggttttgtgaggtgcttggatggtgcttggttagatcagagcttccaacctcagcactgtggacatttgggctgggatcattctgctatcggtggcgctgccttgtccattgcagatgttgagcagcatccctggtctctacccattagatgccagtggcacccccctgcccttcaagtcatgaaaatatgaaacgactgcagaccctggtggagaacagggctagattgatgagactcttgaaagctcttaaatggagtaaacattgcattatgtcagaaatgtagagttctttgcagatttgaagcagttaagcactgttcagaaaggtgaaactacaaaaaaaaaatgatctggctgccatgtacaggaatggtgagagaagagatctccaaaatcaggagaatgagtagcagaagggggaagggagaggcagtgcctatagagattttgaaggagaacgagagaatgacctatgactagggaaaatactgcaagatgagaccaagacgtcttttcctttttgttgttgttagacaatgaggaatggagctgtaatgacttcctttagacaagataaatacagtgtgagagtgagaactccaggggcctgcataacaggccagggaaagtgggactggagctccattgagtacaaagccactcccttaggctggatgtggtagttcacacctataatccctgcactttaggaggccaaggcaggaggatagcttgaggccaggagtttgagactaacctgggcaacataatgagactcccatctctaaaaaacaattcgctgggtgtagtggtgtacacctgtagtcccagctacttgggaggctgagacaggaggatctcttgagccgaggagtttgaggctgcagtgagctgtgggcatgtcactgcactgcagcctgggcaacagaacaagacccagtctcaatgattaaaaaaaaccacccacttcgagcattttccaaatgactgacatgagctggctctggaagttaggaaactgcgataaagcacaatctctagccaaaggagcacaaagcccacagaggaaggaatcaaactcccgatcgagggggagcagctaattgttaaaatgacttgaatcttgctatctgcttcacccgatagcagtcataggtgaagccaaggagtataagatcagaaaaggcagagatcagaccgaactcctgcacttctagcacaatgcctggcacataataggagcttattttaaaactggtggaaattaataagagtctaatcacctggaaagaatagggaccaagggatctagaaggcattcctggaggtagtattgcgaagtacatatgggaactactaatagtaaacacttaccaagaagcctaccacacatcagcactgggcttggccccctgtgagaaacctgtcacgtgctgggtgctgtgcttggcactctgtaagaagcctaccgtagagtaggcattgtgtccagtcctctataagaagcctatcgcgtaccaggcacggtgcttggcaccctgtgcaaagcctactaaatgccaggcactcggaaatagtctcatcctgtgatggttaaagctgtggcacagatgagttctcagaaaaagggattcagaaagagaaaacagagtggagagccaaagacccagctggagagcaaagtcaccataaagaggaatacttttcttggcaaggtcaaagggtttctctctaagtaccgcctctgttggaacctactgccactcaagagaaattcttccctaatctgtgtgggcaagaaggaaagaggcagcattcaccatccagggcccggggctggggacacaggaaggacagacatgaaggtcttggaacagcaactctgaaatatcttactgctgaatttggctcatataatccccgagctggggctatttgtgtttgctttttaaatccgcagagatttatggcagcaggaaaaagcacacagaggaattgctgcatttggccttctgccacaccttcttcgctttcatgtaataatcatacatatgcaggcagtggtgaacacccccagaaaccggagtcagggggcacagaaatgatgaagatggtctttgttcctctgatgagccttccggctccacttgtgattttcatgattatttcattaaaagggctactgcagcgcttttcagtgtgggtgtaactgaggcagggtcagtcccaaggctgctcatgggaccaggaacattctaaatagacccaactgaatccagttcagtacagtctttctatggggtctgtcatagaagggactcaacagaggtggagcacttttcaattttgaaattcttacccgaaggaacatttctacccttgaaaggagcaatagctgctggaatggtttgacagaaagagcaaaagcatcctcaccctcaggtgctgagaatgatatctgcctctgcccaacttctccccctcagaatccacctcccctacctcctcccaccctccaccccaccactgaccttcaaaaggatgcaatgacagcaggaaggagaggatttgtggttctgttgacccccagccatgcatgtgatccaactgtagaaatgccgagagagaggcatggacgggggcaggtggcctgaatgtgaaggagacccacaagtgtctccttctagtgttaagcccaagaaagcaccccccagcttttctcatccctgctaggtacctgcatggcatagaagtgacagtggtggtcgcctcagggttggccgctacttaccctatgaaaccctaattcacctttgatgcccttgcctggtttctagatgtgatggaacaaactaaggtcttcccactctatgcagtgggcccaggggtgagtcacctgaccctcactgagcctcattttccttgtctatcaaatggggataatgatggccccagagtcagaggattggcatgaggcataaatgtagcctggataacagagcaagacccagtctcaatgattaaaaacttacgaacttcttagcattctacttgggacatagtaattgctcaagagtgtggcacactctctttggaaggtcaagagcatcaagcctcagctccagtcatttctgggctggtgtctccacccaccctgaaggttgagttggagaggttttgcgtactctttcttttcatgcccttttcccaaccaaaagacttgaaggtggggcattttgaaaaatggtaatcaatcaaagctaccatggacccagagcttaccatgaactgggctctgtgttccatttgcatcagttcattcaagcttcataaagaaaatgtaggtgttatcaccatcatccccttccacagttggggaaactgaggcacagagaggctaagtaactcacctaaggtcacacagcatgtaagtagcagaaatgaatgcttaacactgaaataaaatgtatattcctaagcccagtactgtgttgcccttgagccacccctctcccctgcgtacccacctccatgtgagctgttgattgtgatagccattcttagggtccttctacaaggagtcagtggccaggcctcctgattgccatggttggtgtcccaaagccttctcactgtcctaggtcaagctatcatactattctctgagaagtgccttccctttgtcacctggccaatttctgctctgaaaacagacctggggagaagtgagggagacaggaacgcaattacccagcccataatgcaaggtgaagacctgaccaccaacctgaagcccaccaaccaagagtccgtgtggtccaactcccacctgcctctccagcccaacctcaaagcaagcggccctttgttttcatgctccagccacagtggctgcttcccagtcttcctcccaccataaggcctttgcacatcctgttccctctggttccctctgctgccaaccctcaacagagggtcatcttccaatgctcgtaagttgctctattggagcagtgatcactctgtgtttggttcatttatagatgtctgtccttgtacaccatgagctcctggatggtgagggcaaacttctgccttctctgtgtattcacaactcagcatgcacagtgcctagcatgtagtaaacactcagcaaatggttatccagtggctggaaattaagggtaaatttgtgggactctgaacttgggtctttcctataaactctcggggaaaaccagcttgaaaacagaaatcttttggtctagatgtttgatctaggccaaactttgatcaaatgtaatcagactctgaatgtatgtgtatttatttcaagacaaaatttaagcctggatttttcagagactaaattaaattggctgcttctcagagctgcttgctaaagtgatgcttccatacttaatactggcttgaacatttattaagtcttaaactcagactggtgaaaaggccatcatctctggagttaaactagacctagaattgaattccagctgtgctagttacgtaagcttgggcaagattgctgcatctgtaagccgtgatttcatttttttaaaagtggagttaaaatgcctgcctcataggctttttgtgagggttaattatgaaatagctgttatataggagagctctgaaatatgagtttcctttccgaggaagcacacatatagagacacagaatagcagtcttaaactgttttcttcatcatctttcattcattcagttacccattcattgaaacacttgtgcattcctctggtcaatcactatttcttgagaagcaacactatatccaacaggaagagaagggccatagatattatcataagcagcacaaacatggtccaaggggcttaaattttggtggaagagaaagtcaataaataaataattacaacctatgataggtactaaaaagtatctccagtgtagacattaaagcataaaggaaactaaaatggagatccgttttaggtggagtgattagttacaggtcctctggaaagatcgtatgtgggtgaggtctgaaggatgagaaggagccagctctaaggagagcaggggataggctgtccaggcagagatgacagcacatgcaaaggccctgaggtcagaaagttctagggacaatcaaaaggccaaatgccttgagctgtgggtgggaggtgaagatggggaagtgcacaggagtttataggccactgttggctatggacatgccctgcttctctgcagaaccagagtccagcggacagagcaacaggtcaaggtgggactaatacaaggagatatgactggcagtttgtgggagagaatgtggcccgccaagtagaatgcagatgtgaggggcatcagaggacaaaaattcaaggctgggcggacccatcatgggtacagcaggaggtatgcatggcctaatattggtgaggctgcttctgaccacaggtgggcatcctgcaggcaaggggagaggtcttggagaaatgcagttcactgagatgacttgatggctcaggagggtgggctggtaaaagcagaccaggaccccactctcgcaagagtgagcaaacttagcagaaaacagacccgggcagaagtgagggagacaggagcacaattacccaccccataatgcaaggtgaagacctgaccaccaacctgaagctcaccaaccaagagtccatgaggtccaactcccacctgcctctccagcccaacccgaagcaaacacccctttgttttcatactccagccacactggctgcttcccagtcttcctcaaccacagggcctttgcacatgctgttccctctgcctaggacactattcccttcactctttacctatttaactccttcccttccccagggatgcctctctgatagccctgattgggaaaattctccatttacacaattctagagccccttagtggcatgagaccacatttcaacttaacatttatttgtgtaattattggtgaatatctgcctcttatacgctccaaaaagaggagaaagcaatatactacatcctccagtgcctagtgcagtgcccactgctgaatatttaatgaacaaattaatttgtaaaaaaaaaaaaaaaaaaaaaaaagccagtctggctcctaagtaactggcttagatcagtaattctcagagcgtggagctggaattagcagtggcagcagcacctggaaacgttagaaatgcaaatccccaccacagacctacaggatcaaagaaaggaaggattgcaatctttgttttagtaaaccctgcaggttattacagtgcacacttaggtttgagatccactgtcctaattactttgttttgaactttcaggtgagacttaagaggacacccctgtgcagataagagctctattaggcaggaagctaagctgatcattttggatgagccttggtagtgggctggattttggacatgacatgagggcttttgaagggcatagtcacataaagactcagctgcatagggaagctgacttagtctctgcacccaggagatgtacatgcagtttcctagttagtgaaactgtggacacaggacccagctgttaacacatgctgcaatgcctaaattttgctagggtgaacttgggggtagaaaaattgagatatttgctaagacaagttaatcctgcaaacttgcaaacacaaggaatgccattcttgtctgaacagagcagggatctgccagaatagggatctctgtgggcatgaatatcttccccacaatctccagagtcttcctgttctacagccccctcctgtatatgttctaagagtgggagcccagtaaaagttgcttacatgcattagtgagtgagtgagtgaatcaatgaatgtataaagaaatgaatagaagagatcaacaaatgctttgtctaatgcagtacaaatgtggcttctttctactccacaacctcccattgctggaggaagttcatctctatttaaccctcttcctctcagagtcagttttaggttggacctagacattggagaaagagaagcttatgagttagactaacgtgctttatgttttcactgtaaagggaggttaggagggaggaaggccaggccctgctagagaagcagccccatgaagacagggagaacactggtttggttcactctatctccagcaccttgaacagaaccaggcaactaacccttgctctacacataggagttgcctgagcctccccttttgttgcgtcatttcattcttaccacaaagaaacatactagctccactttacgaaggataaagctgaagctagagaatttgagtaaaggagctagacacaaactcagacccactgaccccaagttcattcctctggcccaggctggttcccagtggcagctaccacccagactcttagctgcctccagttttgtgaaatttttatcactggatctgggaagacatatccacctcctgggcttctgccctatttattgctactcctggagctttcagggttcctaattctgagagtcagacaatatgacacaggaaaggaaagggattgacagtctggctcctgacaggtcacagaattttgctttgccttctcaccatttagaatctctgctgaaggtgtggacatcgttttggattgcctctgtggggacaacactggaaaaggtctcagtcttctcaaacccctgggaacctacattttatatggtgagtgcaaaacagcagcagggacgtggtcagcaataggtacctctacatatgtgcctgcaaaggctctgaaaagtgaattgtgctgatatgttggggtagtgggatgggggtgtttcattttttaatgtttcctataatgtttctattactgtgagttattttcaattttaaaataacatgtgcctactgtcctatatcctattatttcaaatgggataaagcaagaccaagccaatgtggtcattgatatgactagaaccactaagggacatcacccacagaaggtagcacaggtggaaaatatgaatgacttcaaaggaagttcagaaataaagaaggcatgaaggacccacagtaggatggggaagagtggctaggatatgcatgttttaagggaggatctttactatttgagaagttgcaaagtacacactctgcttcccctaaactactcctgagcatcccacgcaagacagaagccctgaatagatggaacacatgtctgttcttcttctcctaaactcctcctgagcgtcccactcttaagacagaagccctggatagatggaactcatgtctgtttccatctctttctacattcacttctatgtcttaggagtggaagagatgtatgcaaaacaactggaagaagattttctccagcaaaatgaggctccagggcctcctttctctcttctttttcttcttttctgtcataggcatgcaaaccaatttaaacattagtctccacaggccgggcgcagtggctcacgcctgtaatcccagcactttgggaggccgaggcgggcggatcatgaggtcaggagatcgagaccatcctggctaacatggtgaaaccccgtctctactaaaaatacaaaaaattagccaggcatggtggcgggcgcctgtagtcccagctactcgggaggctgaggcagcaggagaatggcatgaacccgggaggcggagctggcagtgagccgagaccgcgccagtgcactctagcctgggcgacagagcgggactctgtctcaaaaaaaaaaaaaaaaaaaaaaaaaaaaaaaccacattagtctccacaaactaaaataggagtatttgaagctagatggcataatctgaagcaaaataatattgggtttatccaatgtttaagattcttggtaccttgtcccctgtaggtacaatagaaaactgagttttaattctggctaactcagaaaaaaacacttatttccctgctatttcctgaagagcttataaaatagatatttgagaggtataaatatgcaagcatttttttgtcatcttcagaccattgtaacagaaagaaggctgaactcaccagaggcaggtaaacatcccattgctggaatgttccagtaatttcaatcatagccatgtatttcctttgaagtggacgtgtggtttattattatcagtgagagtccctgcacgttgcaaggatatcggatatgactaacatgtgagtcaaatgcagatggacgatgtagtcatccttacttatcatttaccaataattctatttttgtcccagtttcttgatgtcattttggtgaaattcaacttgattaatcccatgtgagtagttcacaattatctacttcattacgttgatcacttggtcactaattaatcaaagtctagtactgggatgccccgtggtactcaccccataaaaacagaagcaatggttcactattatgctggtgtaagggtaattgcagtcttcggcattaaaagtaatggcaaaaaccacagttacttttgcaccaacttattaactggctactagtttacccaggctaaatagtgtaaaatacacatgactattttattaaataactcctctctgagaagaaattactccaaaatctttgaagacaaggcaggaaagttgttgaaaaagcacctgtatggtatttgaatgttccccatactgttaagagctctctcattcccccctcccctgccccgaaaccttataaagggtctttactctccgtatgagaatcttagggaatctttcccaactccacctcccatctgccctctgaatactgcttgtccaattggcaaaactcagtttctcatatgcttgtctcagacctctttggagctgacacatggatcacaccatttctttggtccctgggccccttttcattctcacctgtgagcttctatacccattttttccaatccatctatattttaactctgctccacctctcccaccatttaggtacccagtccaggtcagagccccaagcccctcacttgctggggaatcaaattcagaatcacaaagtagattcactaaggagttcctttctcagcctcaaagaacagacctaaaaagacatttcagcaactcatcattttattcaaacgttggcctacatcatatttttgctatatgccaaattttgcaaagtaataagacggtcatcatgagaaatgtcactttctctttgatcagggacagtcagctaacatagtcaactttatgcctcattctcattcccctcactttgccaaggcttaattaaatttgttttcaagatttctccagttccggaccaaacaattgccatttttttcatgcataacaagagatgtccattttcattagcaattgcttaatgtgggaatctttcattttcaggctcatccaacatggtaactggagagaccaagagcttcttcagctttgcaaaatcagtaagtatccaggcacatctgatgtactgtggtggcatgttgattcacatgttgagagctttgtttttgtttgtttgtttgttttgagacagcgtctcgttctgtcaccaggctggagtgcaatggcacgatctcggctcatggcaacctccgactccctggttcaagcgattctcctgcctcagcctccctagtagctgggattacaggcatgcgccaccatacccagctaatttttgtatttgtagtagagacggggtttcaccgtgttggccaggatggtctcaatctgacctcgtgatctgcccgcctcagcctcccaaagtgctgggattacaggcgtgagccaccgcacccagctgtgagctcttctatcataaggcattgacttaatcttgtctttcaatttcctcgttcatttcccataaaacctgcactcctgccctattccctgcaaatggtcaggaccagaatttagactacttttgtctaaatgaaacagagaggtgggagtgtcagagaaactcaagaaagctacagctttatttcagtcaaaattgcttaagtgttggtgtctttaattattggtcaaaaatgaacttagcattagtgcattttctttgctccatagagcggccagcctttcactttgctactttctgaccaggtctctgggggtacttgagatttctctgtctccccatcctcttgaatcggagatagaaatgaggaccctatgaccttaacaagatcctgaggtgacttgtagactcagacaagctcatgaaccactctcttgggtgatcatgctttcaatatggtggttagtttgtcggccattgcaaagcgacatccctgggcattcacctcactacaaattgactctgatctatcttcctatctggagctatacttgctagaattatactgatgttggcttgaacttttttgagaccgagtctagctctgtcacccaggttggagtgccgtggcatggtctcggctcactgcaacctccacctcctgggctgtagcaaccctcctgcttcagcctcccaagtagctgggattacaggtgtgtgccactatacccagcgaatttatgtatttattttggtagagacaaggtttcaccctgttacccaggctggttttgaattcccgggctcaagcaatccgcttgcctcagcctcccaaagtgctggaattataggtgtgagccatcgtactcggccaaacttagttttttaaatatcatttcaacaccccttccccagcccaaattccttctcttctttgaaatgaaccaccagtacaccagcaccagcccatgttgctttttttttttcttcgcacgttccagggtattttttttttttttttttttttagtaatttcaactttttagattcaggaggtacctgtgcaggttttttgcccgggtattgtatgatgctgaagtttggggtacaaatgatcctctcattcacatagtgagcatagtacccaatagtttttcaacccctgcccccctcccagtcccctttagtggtctgcagtgttaactgttcccatatttatgtccatgagtacccagctcccacttaggagagaacatgcagtatttgtttttatgtttctgcattaatttgattaggaaaatgagctccagctgcatccacgttgctgcaaaggacatgattccattcttttttatgactgcatagtattccatggtgtatacgtctcacattttatttatccagtccaccattgatgggcacctaggttgattccatgtgtttgctattgtgaatagaatggcaatgaacatacgggtgcatgtgtccttttgatagaacgatttactttcttttggatatatacccagtaatgagactgctgggtcaaatggtaggaacttttatttttacccctccccaacaggggattgctgcttttcacaagggtttatttttgccccctctacttttggacttctatgtgccagtgcagcgtcaattgatccactcatttgacaggcattttctgagcacctgctgtttgtggtattgtgccaagcactgggctattacagcacataagataggtgcactttgggcctttttggttcttatatactaatgagggagacaaacccaaaataagcaagatatgttaattaacatgattataaatggctattaaacctctgaagaggataaaaatcaagtgctaaaatagaaaatagcagggtgggtggaggcaattaaaacaaagtggtcagtgaaaagtatggtaaggagtttggaattcattctaagtatggcactatgtgctattcatatgccctcaaagtgccaacatcagcttccagaaacatcagccccaaacattctggaatggataatactccctgcatttgtgagattcaaatcaaaggtcttctctttgcatttgggctttaaaatatgggtcaaggatcatcctaactacagaaccgacaggaggagcaagaatggagtgtaatgaaggatgctgtctggagtgtgtcccctgaagacaggctttgtgccatgcacagctgctctgttgctgtggctgtaattaacatgatgttgacagactgctgtgggtaaccacactggtcccaaattacatacaattgtaagaagtgttttccctttctcctctaaatgcacaatcccaacacacagtgttaatgaaataattgcagcgtgcccatgctcaatgaaggcattcataaatgcacagccaggatggggatggagattcctctgcccaaagcaggggttcctatttccagaacgctttgtacctggaggtcaagaatgaggatgttttctttcagaggcctgctcaaacactgagggtcatttggaagaaaactgaagagagggcctacgaagaggtggaactttgctctgaaaagtcctagaaaaaaaatttttcaatgtattcaagaagggcttagaaattaaaggtcgactggaattatacaggaatttcccactcagctatcttaatgatgttgcatcttaaaatcgctgcagtttgtgcctcactatttgtcaaacatgctattttctttcacaccataacgatgatgatactaatagaagaagttaacatttacagagcaatctgactccaaatttggagctcttattcactaaaccaaaaacatcttgttcaaattaagataataaaagtggtgtatgtttatagagcacctcatgcgtggcagacactgtgctaagcacttgatatgcattaacacatttactcctcataaccaccccatgaggaacagtgaggaaattgagcacagagaagttaagagatttgcctaaagtcacacagctagtaagtgacaaagctgagattcaaaactaggcattcagctctataaccttcttaaccacaactgtacatttgcagcaagcattcattccacaaacattcactgaggcattgcagatacactgtgaatcaagttattatttttctatatttgctgtatttcccaagttggtttgttttaaatgagggtcctaaaaatcactgtcccatagaatagaattttggatgtaaggaatacgttaagttatttagtgatttccaaaccacatgcctcaccacaccatctgtgccacaaacccttgccaggtaagaccatcaaaactgaaagccaagaaacctaaggtcaaatgcgtggctcttattggtcccccggccctctccgaatgtgcttttgtaaataattttgtatatgaacctcatcattgttttcaacctgccttttccatgcttattctcctagtgacacgagcttcccaattaaaaaaaataaaaaattttcactttagtcagtctccttaattcttttcgaaaacaggatataaatgagctcaatgataacataaaggctatcaatgtttctaaatgcccatcacattcctctttgcatcctgtattgaaatgattttgaacatcttatcccctagaatcccccagaaactggacgcttggatttctaacctataaccagcaccaaaggaaaagcaattaaatcataacaaagcagttggatccccatttctctaggtttccagtggattatttacttattttgatatgaagggaggagatgacagactggaaaagagatggccacattaaatagtttgtaggtatttcacccagaactttagtccagggcatctcggctttaatgctatggatatttggggctgggtaattctttgttgtggattattctttgctgtgaatattctttgtcctgagcactgtgggatgtttagctgcatccctggcttccacccactagacgccagtagcaccacctcccgcttcagtcatcacaaacaaacaaaaatccccaaacaatatcaaatgccttctgggggacaaaactacccccagttcagaaccattgattcagtcccaacaatttggcctcatcatttcttcatgctgttacttcttcctaaatcatccctcctccctcttcatccgatggatccctacccgcctccccagatttagccttatcaaaaccactcccccaggaaagctgcttctgcagtcagagtggccacctccatcatgttccccaccacattgtgtaaacttttctgccatcctagttcctttaacaaccccatcatcaccaccaccattcactgagccaagtgctttatacttaatcacagagaacgttgtagagccacgattcaagtccggagctgatgatcctgaccatgtacttaatatttcaactacatgtggccatgtagttagttttgggctctctctcccacttagacctgagcgtctcataagcatcaatgtctattgcttcccatgcacttgcaacagtgcctagaaaaatagatgcttttaaaaaaaatacaccactgtccaaggcgggtggatcacgaggtcaggagttcaagaccagcctggccaagatggtgaaaccccatccctactaaaaatacaaaaattagctgggcatggtcgtgggcgcctgtaatcccagctactcgggaggctggggcagagaattacttgaacccgggaggcagacgttgcagtaagctgagatcatgccactgcactccagcctgggctacagagtgagactccatctcaaaaaataaaaataaaaaataaaataaaaaaatacaccaccaagagcaaccccttggccagctggaatctgctgagctgcagccccacgttccccctgtagtagctgatgacatcagcaatgctgccaatgtaggcttaaccccggtattgagttcctataacccaataccacctctctttgcagtggtggcaggtggagaaggtgaaccccatcaagctgtatgaggagaacaaagtcatcgcggggttttcccttttaaatctgctcttcaaacaaggccgggcgggcctcattcggggagtggtggaaaaactcatagggctctacaaccagaagaagatcaagcctgtggtggactccttgtgggctctggaggaggtaagaatggtgcttttcttctgcaaataaactcctctttttaactcaggaaggtttgggcagccaaatacaatcttctactaaatgatttttttcccagatgggtttgttttaaatgagggtcctaaaagtcacctgtaccacagaatagtactttggatataagaaatactttaagctctttggtgatttgcaaaccacgtgcctcatcacaccatttgtgctctgaacccttcccaggtaaggccaccaaattttgatcaatgtctacaattcggtgtggttacaagagcatgtgtacattgttgaggcatcatacatattgtcaccttgtgagtacataagagatcagtgtcagagcagacagtgatctgagctaaaatgatttgtgtgctccgctggatgccttgagccccgatgagacattagctatcacgatggactttggaattactgctgaattgttgggtctaaagttggattgagtctttttgttagttgatcttccaaaagttatagtatttggaagcattccttgatcacaagaacattaagaacccctaatggagcctcgaaggatactgaagcatgaactggttgtattggttcacatggcccttgctaggagaaggcagggtctagaaaatccttcaagtaaggggaaggtttgggcatttggggagtcagttaatggcagctccttgtagaagaaatgaagagatgtggcctggattttaagaggcatttcgctaagaaacctaagtcaagatttcttagccttggcttcagggagccatgacgcccctgaaaaatattttaaaatatgtgggaatgttttttttttcattgttttgcattttgcatgagggaagtgccttatggtacaagtactttgttgtacttttgcaagtcacaaatactttttaaaaaaataacaagtacgaaagttctagtgggtgtgcttctggcaagaaggctgtgtctgtttgcctgaacgattacattggcccaaatccaatggcttctctaagcacagaaataccactagaaaggctctttgggggtcactgtatattcaaatacaactggtcctagatcaatggagcaggaatgtgcctatatctctctctaatactgcagtgtcatggatgggcttaaaacctttagccaccaaaaaccttgtttcttatgacaaaataaatactcattacagaaattcctaaattaaccaaaaacataaggagaaaataaactgcaagtccacattccagagaaggataacattgttaacatttcggtttgcttccttccagtcttttttctattgcagatgctcaccgtgattcaatttagtgctaaatcgtatcagataattgtgcatgccttctgctgtgtaattgccaatacagctagcctattgctataattttctttaaatgtttttaattcagtgagtcagacacccatatggtattcactatcatatctcattggaacagggaaagggctgggctacctggttactgggttctcaatggtcaggaaggagagaaaacggaatcatcaagaaaaaagctaagagatatacttgtccatgggccagagaaggtgacttacacttgaactcagtgcccaaaaggacccaacaaatctggtaacatttaagtgagaattgaaatccaagaggagtccacttggcccagtgggttcttgttctagtatttgaaatcaccccttggttacaatggtaattgaatcaccaaacatttactgaacaacaactatgtgcccagtactgggcaaatgctggagctacaatgatgaacaaatggacaagatcccatgacttcatggagttttcattcagaggagtaggaggagatagaaaatactgaagtaaacaataataagcaaggtagctgcctgtcgtaataagttcttagaaagagataaatttggatatacgttggtgagtggaggggggagacttagtttccacagagcaatgttgcttaacttatttttcattgttgctcctctaaagagactttttagatattattttgcctaataaactcatgaagttttactaccatatatgtgtgtgtatgtacacatacatgtgtgtttatgtcctgtgtgtatatctgtattttatatgttaaaagagtaactttattttatcttccaagagccagtgttcatcccactggggtgatatcatgcttattgagaatgcatgctgtagagaaactttaaagagggaaggtttctctcaataggtatcattggagctggaacatgaaagaggcaagaaactaaagggagagaattcaacacaaggagatccctaaaaacaaaggggtgaagaacaaaagattttggtaaatcccaaaggggcattattgtgagccaaggagggaatggtacaaggagagtctgagtaggttaacaagggctggatggaaatttgggttttactctaagcagcagggggctgctataggttcagagtcaggaggtaccacatcctggtcccaagggtgttatccatcaggacagaagctgaaattgccaggcaggatcctgggcaactaggcaactacagaagtctgatattcaaggaagatctcattccagctaaggaataggaaaagcatgctaactacagaccaggaagcctcccaatggagaagctcagctagcattaaggagggtctggccaggcacagatggtacacgtgaggcagcaagactcatctccaaccctcagtgctgggggaaatggtgcttcatgtgtgctggggttgtcagcactggctcaaagactgagtccactaaggatacagagcaaaggtactcaggaccagcactaatgagagatgagaaagccaaggctggcagcgtgcttgactgagtcatgcatcatatgcaggcaggtctgggactttaccttgaacatacttcttccatctttattcttagcactgtcgtctaagctgggtggactcaagcaatacctaaaccaaatcatgtccaaccttgcttaaaatccttccatggcttcctgctatacctgaaatacagtctaaattcctcattgaggtctgtaaggccctgcactgtgtgactcctgcccatccattaccctcacctcctccacccaagcttcagcagcattcatgtttctggtccttgagcccacccaggccttccctgtcttgagccttcaaacatgttgctccttctattttgaacactccttttcccaatttttgacagtctgcttccttcaggtctcagcctcagtatgacctgtacagagaagccttccccagccccactcttgaaagtagcaccttgcacagccactgcagaccaggccattctgtctccctttactccatttgatactctccattgcatttactgtcagttgaaatgatcctgttcttttatttctcagcttgcttagactgttgcctcccttccactagaatttaaaccctacatgagggaagacctagactatattattccagaccccagtgcctggcatggaataggtgctcagtacatacttactgtgtgaatggaacaatccaccaatacagagaaagaggactagttggacattttctatgtttaacaataaatatgtgttgattgagtgaattaatgaatagatgaatgaatgactgaacaaggtataattttaaaagattatgttaagacaaggtttctcaaaataagtaaatacataaataaaagacagggtttctcagcctgggcatgattgagattttgggctgaataatttttttgctgggtagggagggactgccctgcgcactgtagaatggtgagcagcatctctggcctctactcccgtaccgccagcggtggcaatagaaaatgtccccagacattgtcaaatgtctcctgggtgggacaagggtaggggcaaaaccactcctacttgagaaccactgcttttaaaagaagccacgatggcaaagacagtcaccagccagataaaggaattctacgttcctgtagcaagatagtcctccatagaaaggagagagacagctgtagcctgtttgccaacaacagcacccacagccactcatcaagaacacccaccgactttctgccggctttctgcaatatctacagacatctgtttggagctgcagtcggaccaaacgtggctgtttatcaagcccacgcagctcttctgggcttgaggagagtgtaacatgcttattacttgcaaacctctgaaggactgtaatgatttttcccctcccgtttggtaaatgattgcacaaaattgcttctcaatccagctctataacttcatctatggaatataaagcccacagggattcaaagaaaattttattgggctctctgagcctcagactagaagatttaataatatcagagacgattaaagtttcctcttagccatctgtctttgactttattgtaaatttaattcacaaagcagagtgggtctactgcagcctcgggtttgcttccagatactaaatgtgcagctgtacgttaagttggaagaaagttagtctcaccaaacagtttagagatggaaaagaaataaaaaatacttgcatttttcaaccaagcagcagtaacagtgttgagagcctactgtgtgctgtgtgctaatcctcttttaggatattgagtctacagaagtcctagacaacatgttaatacttgcatttgtcaaccaagcagcagtaacattgctgagcacctactatgtgctatatgacaatcctattttagaatataaaatctacagtagtcatagacaacgtgtttcctgcccttgagtttataatttaatgtctgagacaaaaataaaatctataaaacaattagacaataacttagtatgcaataacagagtattaatttcaactgcaactggctttgaaaacaagagagaacaatgttaagagtgaatgttagccaggcgcagtggcttatgcctgtaatcccagcactttgggaggctgaggcaagcagttcacttgaggtcgggagttcgagaccagcccggccaacagggtgaagccccatctctactaaaaatacaaaaaattagccaggcatggtggcaacgcctatagtcccagctacttgggaggctgaggcaggagaatcgcttgaacccgggaggtggaggttgtagtgtgccaagattgtgccactgcactccagcctgggcaacagagcaagacaccatttcacaaaaagagagagaatgttgagagatggattttacagatgaggtggggcttgcttggtatgggaaggataggaaaggataggaatgatttggatgacactggagttaccagaaatagatatgacaagcaggaggcacagcatgaacaacatcacagaagtgggagtgagtatggagtgggtggggtagagagaaaagtctgggctaaacaaagcagaagttgctggctgtagaggagaggaagtaagatttgtttggtcaatggagtcaaatcatggtcccctttgctgccaggcagaggagtttgagcttacatcctgggtagggggattgctgttggagagtatggggcctaagaagcatgacaccatttcatcttctcctttccctgaggcccactctggccccaagtatgatcactgtaaagattcacacttagatacagctgtggtctctgattaaaattgctttcccccatctgccacttcatagtacacagagggctgcacagagatctcaacaattttttaaatgttcattgaagacctgatctgggccaggcgtggtggctcacacctgttatcccagcactttgggaggccaaggtgggcagattgcttgagcccaggagttcaagaccagcctgagcaacatggtgataccccatctctactaaaactacaaaatattagccaggcgtggtggtacacacctgtggtcccaggtactcaggaggctgaggtgggaggatgacttgagtcttgggggtggaggttgcagtgagctgagatcgtaccactgcactccagcctgggtgacagaggaagaccctgtcgaaaaaaaaaaaaaaagacattatctttactattttacatgatttatataaaagtctatggctacactctccagtacggtaccactggtcacatatggctatttaaatttaagctaatttaaattaggtcaaattaaaaattcagcttctcggccgggcgtggtggctcatgcctgtaatcccagcactttgggaggccgaggcgggcggatcacgaggtgaggagatccagacaatcctggctaacacggtgaaaccccgtcactactaaaagtacaaaacattagccgggcgtgatggcaggcgcttgtagtcccagctactcgggaggctgaggcagtagaatggcatgaacccaggaggtggagcttgcagtgagccgagatcgcgccactgcacttcagcctgggcgacagagcaagactccgtctaaaaaaacaaacaaacaaaaaaattcagttcctcatgccacctatgcacatttcaagtgcccagtgcagcacagctatagaactgttccatcgttgcagaaagttctgttgaagctggtctatgagacggtatcatccttttttggggaggtaggaaaaactttgtcttcctcactttggctgtagtgaaggtcgctgtccaaatgcagtcatttattggatgtaagtgtcctcagtctcgctgagtcttctgcatttttacctccatgttaatgactatggtttaattagatttgtgtttttcattctaagctgtcactaaacctgtacagagatagactggcctgaaagaataaatgaaggaagaaaatgtgatgctgagcttgacagggacctttatctgtcccaggacaagagggtaacttgataaaaagattaggccgggcgcggtggctcatgcctataatcccagcactttgggagggcgaggtgggtggatcaccaggtcaggagatcgagaccaccctggctcacacagtgaaaccctgtctctactaagaatacaaaaaattagcccggcatggtggcacatacctgtagtcccagctactcggggggctgaggcaggagaatcacttgaacccgggaggcggaggttgcagtgagctgagatcccgccactgcactccagcctgggtgacagaacaagactccgtctcaaagaaaagagatgaatgtgggacaccaaggacagagaaggtggaatggcccgagtcaaggctgtggagtaatgtgattgtcagttctgaagaaacttcaactctagcaccagactgggaaggggacagagaggatgactgaggccaagcatccaaaacagatactgcaccccaaactaggaggcaaagactcaaggagaaattgtggaaagtccaacttcactatggcagatttcaactagctggcatggaccctctttaaagatttaggagctccttctgaggcactgagcacagtgtggggcaaggatttaaaagcatctcctggctctgcagacactgctgctgcaccatggtcaatcccactatgttggggttgacagtgcggttgatggtgggcccttgtgtctcctttgagctgtttgcagacaagtttccaaagacagcagaaaaatttcgtgctctaagccctggagaggaaggatttggttataagggttcatgctttcacagaattattccagggtttatgtgtcaaggtggtgacttcacactccataatggcactggtggcaactccatctatggagagaaattagatgatgagaacttcatcctaaagcatataggtcctggcatctgttccatggcaaatactggacccagcacaaatggtttctagtttttcatctgtactgccaagactgaggggttggatggcaagcatgtggtctttgacaaggtgaaagaaggcatgaatattgtggaggccatggagtgctttgggtccaggaatggcaagaccagcaagaaggtcaccattgctgactgtggacaaatctaataagtttgacttgtgttttatcttaacctccagaccattctatctgtagctcaggagggtaccctccatcccatttgctcgcagtatcctatcatctttgtgcgctcgctgcagttccctttgggttccatgttttccttgttcccttccatgcctggctggattgcagagtgaagtttatgattatgaaataaaaactaaataacaacaacaaaaaaagcctctcccaaaagcaggctgtgtgtgttgtgtcatgtacatagtggtttggagggtgaactggtggcagctggtctggctgggaggctgtggcaattttgggggcatgaatataggtaagccaccaaccaaagtgggggtgtgggatggcagagaataaacccatctcagccattgacagaaaggaaatcagaaataaaggacaaaggggaagcaagagtcagcaatgaccaagggtcttttaagctgggaggtcaggaacagggaagccagcaatggcattttagttagcagggatagacactggtgtgaaaaagttgatgagcttagatgtgagtttggtttaaagtcatagtaggccatgaaagtggagctgtccacagacaagtcaaatcctcaaccacattcaggtgagagaaggctgaataattactactacgactgctactactattactactgctgctactacagtacaatatttctagaggattcgctaagtactaggcattgttctaagtgctttatgtattaactgatctaaacttcccaacatcacaatagtatccaggtattattatccccatcttacagatcgcaaaaatgaggctctagagagattatacttgcccatagtccctgcttaccattgaatttgatggaaatttgaaccccaggaaagtctgatgtatagaagtttttggaaaggtataatgaataaactcattgaagaatgagcaaaataatgctactaggaaatgcttagcatagcatgtttatatgtgccaagtaccttgcatttattaactcattaaatcctcatgattacccctagtggtgataattgttactcacattatgatacaaatgagggaatgaaggcatacagagaggaatacgttgcccaaggtcacacggccaatgcatggcaaaaccagctttcagacctaggcagtttggctctcgagtccatgctatggacattagcgtctccactatgttgggaaagaccagaaccctacaacccccgctttattcctgcatgtctgtgaatccttcgtccttgggcagaggatgaggcatccacagaaaggcagcagtaaaggaaccaccacggccatctgacaggtcattagtgtcagctgctgctgacaagccaggaagtccatagagaaacagcctttgggtttggcccaggctcattgttgacctttcagaaagcagtgtcagtagaaagatgggggcagaagtctgaatgcagaggttggtgaagggaaggtgcagggaggacaggccaacagccagcacaagcctcccacctggcactgaacaggacaaacgcccggaacccagccaggaggaacagaggtcacaggagggctatttagaaagccaattcgtggttgcctaggtctgggggacttggagagaatggagaggaactgctgatggggcatggcatttctttttggagagataaaaatgttctaaaattaatggtagtgataatttcacaactctgaatatgctaaaaaaatggaatcatacattttaagtgggtgaattgtatagcatatgaattatatataaagccgatatagagatatcatatatatgctaagatagatatgctagtatacacgtatattacacatgagaaagggagagattgaagggctgtttaatgctgggatcaggagaacttgggagatggggaagaggcacagccttagaatctctggatccctggcctcaatccttattaatatcctagctgtgtggcctcagaaaaccatcccaccttgtccattctcccagttttcagatgagcaaaattgggctccagaagcaattgctgtgtttgctgtaggtccctacacttcattttttccttcctgtgtgacttctttcccttaagtggaattttaaatttttcagttcaacgtgatcaccccagccacttgcccacacacacacacacactcacacatttccgatttctacgcacattctcccagctggcctcatgtgttttctgcagctcaaacttaccagcactatcacgcccccaggccctgccatgcccttgcacccagctctgctctgagctgcccaatggaccaaagaaattaaggcacagctctgcctcagtgtatccatctgtgacaggctgaagaatggccccctaaagatgtccacatcctaatccctagaatatttgaacatgttacctcatatggcaaaagggaccttgcaggtgtgactaaatgaaagactctgagacaaggagaataccctggatcatgcagatggatccaatacaatcacaagggcctatgtaagagagaggcaggagggttggagtcagaggagcagatgcgatggcagaagcagaggaagaagggtgatgtgatactgggaatgggaagagcctgtagaagccagaaaaggcacaaaaattaaggagccagccctgttgacaccttgatgttagccctaaagagacaatttcaggcttctgatttgcagaactgtaagagaataaatttttgtagttttatgtaaatttgagttaatttattgtagcaacaactggaaactaatacataccactaatgccactcaacaaatgcttacagagtgcctgcctgctgcgcgccaagcaccgggccaggctttgcaaacacagttgcaagtgagaaagcctgggcctatgcttaggggcagccaggatggtggaagtgaacagtcagacaattatataagcagggaacgaagcctggaggaagagagctgggcagggctgagacccaggcctgtgccacagcctgggcaaaggcctggaagttggagagaaagatggaggttggcacattcaaggacagaagaaaggttcatcaggctgagcacagagtgatggggaggctgacctcgaatggaggggagaggaaacgggataggaggaattcccgccaaccgccggaatatacccatccctctggccttactggaccactgtgattttcagaaacctgagactctgagcctccctgcctttgttccagttgttaacttggcctgcatgcccttccctcatccttgtcctcctgcaaaattcctggtcaccttttaagactcagccctggtgtcgactcttccgtaaaaccattcctccctcttgccattatcccaaccctgagttaggaggtactgcttttagatcccatgggcttgcctccctcattgacatgtgcatgggcaatttcctgtgaaaaatggagagaataacgctaccttccttcggtttctatttagagggattaaatgacctaatgtacaaaaggtacttagcttaatgactgacagagagtaagtgctcaacattagctgtcattacagggcattgcaaatgcatttcccccagagagtggagatatttgaggtcagggactcttggcaaggtgccaagggaggagaacacaggatatgccccgcgaaagatttctggggcctcagggcatgcattttcatcagcctggtgcagcatctcccatcaaggttctaagcagacaacttcatctacaccaggagaccagcgtgttgcagaattaggcttattcacagctcagcactccttgttaggagtctgggagctcagctctgaatacattcctgttacaaagaaaatgctcgtccttgcctttacgcctgtcattcagatgaaaatacttcacaaaactggatttccttgtgagccagggacagagtcaactcacactgcccttggctgtgttttaaaagacacagaccaggattctgctgtttccaaagactggaaagtttctatttgcctttgaggttgatggagaaattacttaatatatcttatttgcagaaaggcaacagaggaccagtttcaagatttttccaagatatctgtactgatatgttaatcacagattctttatttgctagactaagtagataactgtgctgcagaccaagattcttgaatcttgggacgtacatttaaatcagataatgcatgagtaaaaggtcacatcctggcagataaacatgctgtggatattaccactacccccacctctggaatccacacttcggtctgagcatcagtttcctccattagaaatggggatactaccatgttccttgttattgcataggatttatgattattgtgcaatcaactgagtccatatgtggtgaactcttgtacactgtaaaccactctgctgacacgaggcatattataatgtgcagaagcaggtctgattggatgggggcaaattcttggtccaaaaaactggttttgttttttgttttgtgtttgagacagagtttcactcttgtcacccaggctggagtggaatggtgcaatctcggctcactgcaacctctgcctcccaggttcaagcaatgatcctgcctcagcctcctgagtagctgggattacaggcgacgccagccaccatgcccagctaatttttgtattttttagcagagtcggggtttcaccatgttggccaggctggtctcgaactcctgagctcaggtgatccaccggcctcggcctccccaagtgctgggattccaggtgtgagccactgcgcccagcccaaactgggtttcttaacccttccacttcctagtggtttgtcctgtagcacttcatttttctcttcctccttttcctcccctataaaataggaacagctgactttatttcccaaaacagttgtgtatgagtttgctagggctgttgtaacaaagtaccacaagccaaggggcttacacaacagaaatgtgttgtctcagcgttctggaggctggaagtgtaaagatcaaagtgtctgcagggtctgttccttctgagggtcatgaaggaatctgtctcatgcatctctcttaggtctggcaatctttggcattctttggcttataagcacatcacctctatctctgccttcatcttcacaaggcattccctctgtgggcatctatctccaaaattcccccactttataagaacactagtattggattagggcccaccctacttcagtataatctcatcttaactaattacatctccacaatctccatttctaaataaggttgcgatggagttgctgggagttaggatttcaacatataaatatttggaaaagaggggggggacacagttatatccataacaaactatgagtcacatacgatcaaaaacgggagatgccttgcaaattataaagggctaaagagataaaattttgcatgagggttaaaagggcaaactccagattaagttcaagtctcccctcctccagttatagctgtgatttcttaggagagtggcttcatttctttcctaagccttgctttgctatctgtgaaatgaagatgatagcagggcctcctctgtggggttgctgtgaaaatatcatgaggctgtgtgtgcagggcttaaggcatgccctggcacccagtacgagccagcctctgttaccagatcagaaggggtgggttgggtggggccctgcctttccatcaccttgcagtcaaacctcccagagctggtttcctccctgatgtgctactgctgtgctgcaaacaggcttaccagtgccctttcctcgtgcttgtactcatttccaaaggcaactgtgggagctgctttatggaacagaagctctgaacagcacaaatgataaacacatgctggtgtttgcattcctctaaccctccaaccatctagtctctgattactaaactgttagcttgttttgggaggttctgccaggaaagtgccacgctccagttagtcatttaataaactctaagtgagcagctgccagcagagccatggacaaatgacaaaggagcaatcatggctacagtgtgatatctgcccagagccaggcactgtgctgagcactttacatgcattagctcatctagactcatggcaatcctgtagggaaagaactattattgcccccattttacagatgagggcactgaggcttagagcattaagtgacctggtcaaggttacacagacaaaaagtggtggagccaaaactcaactctcagactggctctctcctgaagctgtgcttgtcaccaaggcctcaaccccctccaggagcggcgatgactttgtcctgagctcttcaacctggttgccccgtcaggcatcctgatttgcagtggagagattggcttgaacaccctggttcatcagttcctaccttctgtgattagacaggtgacactgcatctcaaacctttctgcatctgtaacccttgctcttcctgcctgtttcaaagtctattgcaagcagtgtgtaagctgtaaactgcatgctgtgtatggaaatgccacagagtgggtgcttgatacaacttgagcttgcttcttcctttctacttcccttccaaaatgtgtgtcattttcatagcttccctagcacattcacatgtgttatcattcagtgagtttgctcaacagacaccaactgagtgaggatggggatgtggtgattgagctctgttcccatgaccaggagctgaaaaccacgtgatgctcacccaacctttccagggttgataagaagacctagatgcggagagcggatgtgttctccaagacacacaactctactaagtagtagcacagattcccttgactttaaggccagtacttgagcctcaccatctccctttcagcctcacccaaatggctacaaattaccaactagttaggctccaatttcattgcatttttattgtttggcagttggacatactccacatgagcatgtttacttcccaagctacaccgtatgcaaggctttgctggaagtgcagaggtgacaattcaaagaggctatacctgactctacaccttctatttgcacagcatttacttgcctttgtggggatgaagccccatagtaaaaccacagagataggcaggacaggtgttatgttcattacacagatatgtgtgtgttataaacatagactgagtaaggtaatttgcacaaggtagtagagctgggaatccaagccacattccttattccggagatcatatgagtatttgtgtgtctgcatatatctgtgtatttgtgagctttgcttatgtgcttattttgccctttctcccagcataattttttctatatagcaattaaaataagctatataaatatataactacaatatacaacatttagaaaataggaaaaaagggccgggcaaggtggctcacatctataatcccagcattttgggaggacaaggcgggggggatcaggttaggtcagcagtttgagaccagcctgggcaacatggtgaaaccccatttctactaaaaatacaaaaattagctgggcgtggtggtagctgcctgtagtcccagctacttaggaggctgaggcgcgagaatcacttgaacccgggaggcagaggttgcagtgagctgaaatcgcgccactgcactccagcctcagcagcagagtgagactgtgtcttgaaaaaaaaaaaaagaaaatagaaaaaaaggcaaaaatattgcccataattgtgccaccctaaacaaaaccattgttattgtcagactgtaccccattcctggctttactcccatacatcttttccctctctgaccaccactccccccgcaaccagttgtcattataaatgccccaagtctgctcatgagcctttatgagcaaattaagggcatgttatgatgcttttctaagcagagacacagagtcacagcaaaatgcaagaggcatttgctttgggtcagcatcattgacagagcaagggcgaggaagttcacggttggcaagcatcaagttcaaaaggtgaatgaggactggaatgggagaagacacagcaagtgatagccagatggctccgaggtggggctgatgttgagatatacaaacaagatggtggtaggtgtgtgaccagtagtttaccttttttttttttttttttttttttttttttaagacagtcttgctctgtcacccaggctggagtgcagtggcgacatctcagctcactgcaagctccgcctcctgggttcatgccattctcctgcctcagcctcctggatagctggaactacaggcgcccgccaccatgcccggctaattttttgtattttttagtagagatggggtttcaccgtgttagccaggatggtcttgatctcctgaccttgtgatccgcccgcctccgcctcccaaagtgctgggattacaggcgtgagccaccgtgcctggcccatagtttaccttttagttagtatttaatgcattttttgctgcttttcctccgttagtcacagaatcattcaaaagaattgttacctgggtcctatcaagtgcctcttacttagtctcctctcagagcaggtggaatacatttctctttaggcacaatgtggttctaactcccaggtttgcaggccatcagcacttccttctacaccccatggcagacatcactaatcaatcccacttggcatcagatctctctcagcacaacatcccactcccactcaatcagagaagttacattaaatgaaccactgtgggtcaccctcacccctaacctgaaataatctaaccaatgtccagcgcaaccaaagtgggcagagcaagaagagataccaatttcaagaacaactgtcagtggtggtcttattcttgctgtttctcaggataattttcacctcatttatggtttgccgaggaagtggctgtcttaacaggcattttagagaagctatcagccagtttttcagcccaaagtcattcaccattttcctaactctgatttatttgtggcagtgttttcacataatataaacaccagttatttcaggtcttccaatgtgctgcattttaaaaatctaaactttttgggtttatgtataatttactaaaattccattagaaaacaaagcatacacagccctagacattactggttgatgagctcatcttattcctttctttatccttggttctaattagccaaaaaggagcagaaggccatggatggaataagaaatgcatggtaatattcatttctgagtaattaacctcatctgtatatgtcaagggacaatagtcaatggggttttttatataatttatcacattaccataaaaacattgagtagttatcttggtagatgccaaggcatttgatgaaattcagcagctattttttattcagtcactaagtattcttcttaacccaataaatgctttaaaatagaattaaaatcaaaaccaatttaaatgctttaaaatagaattaaaatcaaaaccaatttaaatactttaaaagggaatttaaatgccaaacaatattatatttggtaaaacaatgtaagaccctcaacaagctgtacaaggatggcccctaccagaagaagtgctaaaaagaaaatagatcaatcaatcaatcaatcaatggaataaaaaggccgagcatggtggctgatgcctgtaatcccagcactttgggaggccgatgggggggtggggggggtgtggatcacctgaggtcaggagttcgagactagcctggccaacatggtgaaaccccatctctactaaaaataccacaaaaacctagctgggaatggttgtccactcctgtattcccagctacttgggaggctgaggcagcagaaccacttgaacccgggcggctgagatttcagtgagctgagatggagccactgcactccggcctgggccacagagggagactctgtctgaaaaaaaaaaaaaaaaaagaaagaaaaaaagtaacacaggaataaaaagattataccttacactctcatagtagataatacttttaatgtgcagcattccctttcttaaaaatttccttgagaatagtccatctttgtttttaatagacatctcctgggtttagtctcagatctcatttagtaaattagaattcgccaagaaacttattcttactgaaccggagttttctcacctgtaaatttgggaggaattacgatagatacagcatatgacaagcacacagaaaatatgatattccccccgctatgtaagctctacctctgatttgcttttcgtttttctttttcatttggagtccaaggcttaaaaatgcatttgcttcttgaaataattttggaaatagactttgcaacaggtagttagtacctcatataatacagtcttcctgatccttagtttctgagggtgaaaattaatatacataacacctataatagatactaaaaataataatagcactactagttactgaagacttattctaagccaagcattggactggaccagggtgtacaaaaatggaaaaatcacaggcccaaatatcttacagagaaattgggtacaaccaccctatctagacttggaaattctgatttggagatcgccttgggtgttttctatttttagaaataattattcaatgccacgtgattttaaaattattaggttggtgccaaagtaattgcggtttctctcattacttttttttttttttttttttgagacagagtcttattctgtcacccaggctggagtgcagtggcgtgatctcggctcactgcaagctccgcctcctgggttcatgccattctcctgcctcagcctcccgagtagctgggactacaggcgtccaccaccacgcccagctaattttttgtatttttagtaaagacagggtttcaccatgttagcaaggatggtctcgatctcatgaccttgtgatccgctcgcctcagcctcccaaagttctgagattacaggtatgagccactgtgcctggccctctgtcattacttttaacggcaaaaaccacaatgactttggcaccagcctaataacccaaaaggaataaccatattcccccatcaaaagagaaacgcttctgtattattttacaccactctatcttattcttggtgttactgatttgcttttttttttttttttccattaaaggcaccattggtgtatccatgtggtttgtctgttctgaggtttcattcatatcctgctttttttacaacagcttttaattttaacatgattttttgtttattgctttatttccatcctgtattagtctttccaggctgccataacaaaatatcaaagactgagtggcttaaacaatagagatttgcttcttagttttggagactgggaatttcaagatcaaggtgtcagctaatttggttcctggtaagggctgtctctggcttgtggacagccaccctctcactgtgtcctcacgcggtccccactctgtggagtctcttcttataagggcactaatcccatcatgggggcctgccgttatgacctcatctaatccctaagtgcctcccaaagcctccatctccaaatactctaaccattgcattggggttcagggcttaaacgtgaaattagggagaacaatcgttcaatctataacacttcctatattccctagggagagatttagagcattcttacttttctaactaatataagaactttgggccaagaaatgtgctttaaatattgtttgggcaacatatggattccttccttaatccatatttttatgtaagaaaaattttttttcaattgacacatggttgcacttcattgttttcattcatttgtaagcctacttctcttcatttaacacctactatttaccaagcctgggacaaggccatgaagagttagaaaatcaaaatacctcaaggaaaaaaacaactggtggtaaaggagaaatgtaaaccaatgattaaaatacagtgttccacgctcaacaaggagagaggttcctaggaaatactggtgtcaagtaagaggaattcaaatctgactaatgtggttatgaaagacccttataaaacatcccctctctatcaatatattgggcattatttgtatgtctcttgttggcaacctgtaaagaaaattgaatgttttagatgcaccaaatcttgcaataattttcctatggctaaaagaaaaatgaaaacattacgtttgttggcatggcttgattttcttcaaagaagaaaagaatttgaagcaaaatcaagaaagaaaaagcagtagctgagaggagatgcctgaagttattctcgctgctgacctcttctgtttgccgagattccaaccttactttttacacttaaaaatttgacagggaggttttttcagaagttccctgaaggcaccttctgagtgcaaacatagagtagcctcgccacccctgctgagatcatttttctgttcagatccatttttatgtgattgttttcctgcttctggtttccacctagctgctgtttttaagtgtcctctgttgtaccattattcacaagttgatgttccttgttttattttctaggttggcagccttccctgcatcattattctgtttatatcattagctgcagtgtaggtttgttgtgttacagcatcatacgttatttgctttgcaaatatgactcactgtctctgactttcatcacctgtgtttgtgcgtcctctgaagcgtttataagcttatcataggcctgcagtgttgagaaacatggttctaaaaaatagtcactaaaaagagtcaatagctactgcatctctccctgacattccaagcgttctgtcagatctaggaggtttacgcttatatttactccagacttaattttttacttttccttgactaatttttttaggtttctttactcaaaccttctttgatgtttgaggttcccctcaccatcgctcatgaattttggaaggccttggctcacatcaggaactcatttcaccactgtccccccagtaatgagtgttgaattaatggttcttcccagatgtgcttaaaagttctttaaagtaccttctttattcactcatcaaaaagtttgtcacttactctgtgctaggggatgttgtaaggtgaggacagcaaagcccctttgttttaatgttgagagcctggagggagagagatttgatgtttaaactcatttgataattacagtgcaatgtggagacggctttcagagctcctttggaagcaaaacatcaccaggtctggggaaaaccaggcaaagcttcaaagacgatgttgtgcttgacctggttctccatcaccagcatacttaccattttacactgtgacttgcacaataggacagtcatacgattgatggacagatgtcaacacttagtttgggatcgcctcaaatcagagcctgggatacagacttatgtgcaggaacttatttgagaaatgatcccagagagaaaaagtgagggagaagaagagcatctggaaaatgaaggaaggatgggttatcaaaggcagctactgctgtgagtgactggtgtttgatcccaatccctggggaaactacggaaatgcaactcaaaactgtcttcctgaaaaactaaggggggaacggtcactccccattagtcaagggtggctccaaagcaccaactcccagtattttagggttgtgcatgtgagtgggctgccctctctcacatcagagctacctctgggtgaagcagagctaaaggcagggcccaaggaactgccatcttccacatgcaagaagttgatcaaagtctgtgtggatctggccctggcaacagcagctagggtataaaggggcccagaagatttaaagtgatgtagaagaggtgttcaatacagtggattcaatttctttcatgggataagatatagggacctatgaagttggttacatcttgcaggaggcagcagagaaaactcccaattagaggtctacacagtgaaatgctggtaaatattaaatattttaacaaccagccctagcgggggaaaaaaagccctgctgtgtagcattggccaatttccacgctgtaaatactcccatcgtgaccaatagcgggttatcaacatgacatcactgaatacagaagtgggaagagatgtgcacaatcagctatcggagtcagtgccccatacgtattccctggactccagttccacagagttggctgacaatacgatggcctgaagggcagattccaccaggcacagagctcacttttgctggtctcctgtgtgcagaaaccctggctatgtctgtgtttgacaacctggtacaagataactggggaaaatctcagaacattgagaattttttgctgtgaggctatataaagaaatcaatatccaggcagaacctctctcagcagccctaggcaccaggcctgccttaggtccattgctgtataatccttttggtctctgttttgctctcacttcttggacaccctatgcccagctcaagtccctcctatgtacccccagcactctattacttccaacacaaagatatatttttttattgtccatattttccataaagctataagctttctaaaagcaggtgtagacatcatgttcagttttatatccccaacagttaatttacaagctcagtacccaaaacttcatagttctcctcctcccctatcctgcagggaggagtggtgtcaagtgctagatttacccctgagctaggcagttgtggtctatcaaaagcaaaagcccttagctatgtttctcaccatccatcattttagtgcctgtttagagagaatcataataaaagcagagagtagcagtgaaagattgaaatatccacttcaggcaatgatagaaaagccatcaaaagggctggacacgggggctcacgcctgtaatcccagcactttgggaacccgaggcaagtggatcaccaggtcaggagattgagaccatcctggctaacatggtgaaaccccgtctctactaaaaatacaaaaatcagccgggtgtggtggcggacgcctgtagtcccagctactcgggagggtgaggcaggagaatggcgtgaacccgggaggtggagcttgcagtgagccgagatggcaccactgcactccagcctgggtgacagagtgagactctgtctcaaaaaaaaaaaaaaagttcaagaccagcctgactgacatggtgaaattccgtctctatgagaattacaaaaaaattagccacacgtggtggtgagtgcctgtaatccctgctacttgggaggctgaggcaggagaatcttgcttgaattcaggaggcagaggttgcagtgagccgagatagcgccactgccctccaggctgggggacaagaaccaggttctgtctcaaaaaaaaaaaaaaaaaaaaaaaaagccatcacaagcctcttcatgattacagataataggccctgttggagttcagaaaaagccaagaacacttcccgaagctgcagaagaagaggtgctcattgtaggatcgccatgacctgtcagtggctcaagacaggaaaaggaggccgggcgcggtgactcacgcccgtaatctcagctctttgggaggccgagatgggcagatcacaaggtcaggcgattgagaccatcctggctaacacagcgaaacccgtctctactaaaaatacaaaaaattagccggacgtggtggcaggcacctgcagtcccagctacttgggaggctgaggcaggagcacggcgtgaacccgggaggcggagcttgcagtgaaccgagatggcgctactgcactccagcctgggcgacagagcaagaccccgtcttaaaaacaaaataaaaagacaggaaaaggagagtggaattgagtaggaggaaagagagaagcagggggatgtggacaaaggatgataataatatgacaataacatacagcaatgatgataataatcaacacacattgagcattgaccatgtactggacactgtcctaaacattttataagggctgtatttcatttaatcctcacaataaccatgagaagtagatgttattatttatccctatggattacagaagaaaatgaggcacagaggagtaaagtcgcttgcctgaagtcacacagtaagacatgaaagacaaaaacttaaacagcttttgaaaattaggtgatgatattctgtcataagctatatatttcttctaaatcttacctcctctgcacttcttttccttgcctctctgcagtaaggattataaagatttcttggcaggtgcagtggctcatgcctgtaatcccagcatgttgggaggcctaggcaggcagataccttgaggtcaggagttcgagaccagcctggccaacatggtgaaaccctgtctctactaaaaatacaaaaagtagccaggcgtggtggtgtgtgcctctaatcccagctacttgggaggctgaggcaggagaatcacttgaatccaagaggcagaggttgcagtgagctgagatcgcaacaccgcactccagcctgggcgacagagggagactctgtctcaaaaaaaaaaaaaaaaaaaaagacttctcttgagctactgagtgctgagcactctgcctgtatcttttcgtgcaatctacccacaaccaatcaaactttggtaggtaagggggcaacggttcagagaggtttaggagcttgtccaagatcacatatctgctcagtggaggacctgggatttgaaccgacatcactggggctctgaatttttccatgcctgcatacattcctgcccttcaacccagtccagcctgctcgccctcccttcttgcctcgtaagaacggctcctgcgagaacaccacaggcctatagaagaattcagtttgaaaccacttttcaagaatgtgacaacagccaaattgctagagagggcagttttaggaaacttctcatttctctttagaaaacaagaatgccctttaaggtgaaattcaattagagttggaatattatttgcaaacatatgaattattctcataagggaaaaaggcatccctgaagtcctacttgattccctaagactctggctagggccccagaacctgatgtgtaagcatggatagcatgtctgctttgaggaaagagaaaatgaaaacttgggaaatggcagctgctctttttctcgtgaagggacatttcacagatgtccagttaaagctaaaaaacgagcctctcaggatatgtttcacaaacatgaatcctagtagtttggaaattcattatacagtatcacttcctaagaatacactaggtggccaggcgtggtggctcatgcctgtaatcccagcactttgggaggccgaggcgggcgaatcacaaggtcaggagatcgagaccatcctggctaacacggtgaaaccccgtctctactaaaaatacaaaaaatattagcagggcatggtggcggctgcctgcagtcctagctactcgggaggctgaggcaggagaattgcatgaacccgggaggtggagcttgcattgagccgagatcgctccactgcactccagcctgggcaacagagtgagactccttctcaaaaaaaaaaaaaaaaaaaagaaagaaaagaaaagaaaagaatacactaggcatcaaaacatttaaaagactctgagaagccctgcattaaagaaatctccttgacattagttaagctactacttctcaaaactgtcagtgcatcatcataattattagacatttgttcagtatgtgctatatgccaggcattctaagagcattacgacagtacatctttaaacaaccccataagatgcaattgctatccccattttaatagatgaggcaaaagaatagagagattaaataactttcccagagtcacattgctaacaagtggcacagcagggatctgaacccatgcaaccttgcttgtaaccactacatgcaaacatttactatcatcccacaggcagggacccagaactggtttgcagtaacctgccagtgtacaccaactgtaccacccagtaagaccagtgttcaaaccagaatcctagctgattcacaatgaaaaacataacctccatctcagaagtgcaatatcgttggttatcccagtgtcccagttgggaagaaaaaggaaaatacacattgtaagcagccaaggtccttggttatgataagggagcagcaaaacaatgaggtgattggtggctttaattacttgatcattttcccctactatcagccctggggagaccagaccttctcatcctgtggcatagtgtcctgtggggtactaaggattcagtacttctcttaaattcataaaaacaggcccctgcccaaggccctgggcttcataggaccctatatggaccctccctcggcctcacccttgctattctacaaggccaagaggatataggcctatccaagacttcagcatcccctgaccaaatggccctgagccctcttgcagtgtcttcacaagcttcttttctaggccatcctcctgtgggtcaaatgtgccaccagattgcacttcccaaagcctgaggagtggctgtttgtgggaggtggggaaggagcttgcacgtgcagactctgggtccacacgagtgtacacaaggcaccccaaggggatggatggggctgagatatgaagaaagggactccccagggagtggggtcagctgtcctcactccccacctctggcatagaactcgggaggatgagaattccaaatgggaacctggtcctcctgggcttgatgatggtgtatttgtcaagggaggaggatagaaatagttcacttaaaacaaactgacggtatgttaggttgatttatgtccactgaatatttagacatatgacacatgggcccacatttgtactctttgtagtctcatcttggaccccacaatataaggggtgggcccaccatacctcttcagttcctctaaggcagtgtgacatagtagaaagacaaacattcagtacacatttacagaatgcctacattttaccatgagctgcctagaaagagtcaagcctgagttaaagtcctgactctaccacttcccagcataagtgagttctctttagttgttttcaacatcagttgccttatcagtaaagtggggttgatcaccctcagcaagataccatcaaggtaggggtgaagttaacataagtaaagcgcctgggattgagtctttcatataatatgagttcaataaacaaaataacatgatgaaaaacacaacagaaatgggaaaatgttaataatggttgaggctgagtgaatggggacaaggtggttcattatacaagtctaccttgttttttttctgcacccaggctggagtgcagtgacatggtcacggctcactgcagcctcaacctcccaggctcaagcggtcctccctccttggcctcccaaaatctactttatgtttattattattattttttacaatagaatgaaattttaaaaattaaacatagcatccaatttcaactggcttattctcactggcaaggcaaacatgttgctatttctcctattgtaaagtatctcttgacctcaccccacctgatagctattgccttagtctgctcaagatgcttgaacaaaaaaacaaagactgtgtgcttaaacagcagatgtttctttcccacagttctggaggctcgcaagttcaagatcaaggtactagcagattttgtgcttggtgagggctctcttcttggcctgtagatggccgtcttctcactgcttcctcatatggcagagacaggaagttatggtttttcttcttcttcttctaagggcatcaatcccatctcgaaggcttcatcctcattactttatctaaacttaacgccctcccaaaggcctcaccccctaataccatcacatcaggtgttacggcttcaacatatgcatttgcgggggtggggtcataggcattcagtctatagcagcttttgctgtttctccgatcccctttgctacaaaacatttagaaagagttgtctatgctttatttggattaaatgatttaattttaatttcatttgaaagtaatatttttattgtggcaaaaacacataaacgtactgtcttaaatttttaagtgtatagcacactgttaactatatacacaatattatataacacatctctgtaacgtttttgtcttgcaactctaaaactctatacccattggagttgtctatgctttttgtctctaattctttccttctattctcatttaaatttagtccaagcaaactcctgcccccacattctaccaaacccactcttgtcaaagtcaacagggacccccctcccccaacaaagttaaatccagtgatcagctctcgatcctcatcatcttgatacagagacccccctccctctactatgatgcttccttcagttggcttctaggatgcccttccttgcttgttagtctccattgttggttcttctccttgaccgctttatcttgcaatgtcccagggctccgtccttgggactccactctgggacatgttggcatctggactgggccaggttattctttgacatggttggagggggacagtctatgcataaatgtgtattgtaacaaaggccaggagctgcctaagacaatattggacatcagatataaacagtaagtttaagatcctagtcagacatagaattaggacataaaaatacaataaatttggggatgtaagttaggggaggtgaaagagccaggaccaactctacgaacctcatgaggatatgcagggctccctcttggtagagaggctcttattcagcaacaacattgactgataaaatgcctgaaggctgccttattttctcaagctctttggtcatctgttcttttgaaaaccaaagccactcactcacacagcaagtattcagagagcttttactgcagcccagaatcacattagacaatctgaattacaaaatagatgcagcgtatgctggagctggctcataccagctcacaagagccaattgttaaataatcaggaattttgtgagccagtcattcaacaaaactattatagttattaaattatataaactaatgatttaaaatatgtattaaaaacaaatggaataatcatttataacttacaactttttagttatattctcatttggctatctatgcttttgaggttgtatgcattcattgtacctgtatggtggagtactataaaatagcattaccatgcattgtgtcccaaccccactttcagttatgtcattttggtaatttgaaaatcagccatggtgtgagcattcacaccaaagaaatcagcaaacgctacaatccgggcttgatttatcacttggtttattgtgtagatgaaagaaagtaatggaaaaaaatgtaaataacgcaaattaaacttgaaaatacaccacgtatattactgaagctgaaagaggttacagttcattgaatgaaatttgtatgatggtaagaaagagtgttaccatagatcagttatcagtcacgtatcagatttaataacaccaaattgattgggtaaagagttgttgggccggttattgaagctgaaagaggttacagttcattgaatgaaatttgtatgatggtaagaaatagtgttatcatagatcaaatatcagtcacatatcagatttaataacaccagattgattgggtaaagagttgatgggccggacacggtggttcacgcctgtaatcccagcactttgggagactaaggcaggcggatcacctgaggtcgggagttcgagaccagcctgaccaacatggagaaaccccgtctctactaaaaatacaaaattagccaggcctagtggcacatgtctgtaatcccagctactcgggaggctgaggcaggagaatcgcttgaacccgggaggcggaggttgcggtgagccgagattgtgccattgcactccagcctgggtgacaagagcaaaattccgtctcaaaaaaaaaaagagttgttggattggaatgcaactcaatttgtcaaattgtgattgaatcgtaaccatagattggcaaaactcaacaaaagcattctctggaaacagactacataggctttacagtaaagagtattgtatatttttattaccattcgtaaattgtgtactacacatcctctatgtcagtaaaaaattatcataaatgtatgcatatacggattttttcagagagtcagttattaaacatttatctgcacaccagtggctgtgagcatgatcttgatacacagatgtttagagtccatctggggggaaacaaatggtatggataaaataagaattagaggacaaggcagtatatgacattgtttagtgtagggaaatgtcacagaaggcctgtgagttggtctacctatttgtgagtcaccaagaaggcttccccagaggagtgggacttgagcaaaaccttgaaggaagtgcatgggttaaaactgcataaggaaaggcctagaggcaggaggccctgttgttggtgttccatcactacagcaattgcaagaccaagcctgtgggaatgaatgaaccaatggagaactaatggcaagtgaggttggctagaagacggagccagatagagggtctcacaaagcagcagctgaccctgagacagagaatcatatacaagatgtgtatttgggaccccagaacacactggtggaagagatgggaaagttagacgaggaagggaagacaactcctgcgaagtgcattgtcaagccagctactcctgtgggtaaatgaaggctaatcctactggggcgctatgagaagcagtgcacaacacccagctcggatgaggagctggcatacttaagcatcaactcccaaaagtcattcattgagagctgttctgggaatgcggaacattaattccctggcacttctggcctgctgtgcaggcagcatcagcaagagaaagccttcagacgaagaaatgggggtagtagcacggtagggtctgtacgaaagggggccaagggcagggaaatcacaacctctgctgtaattcctggaagtcagtttgggtttcgtgcactcaacagtggggactcactgtgtgttcttgagcaaagaagtgtccttggaaatgctgcctcctctagaactctccctgcaacagcgtccttacaacatggtatggcgcaaggggctcaggttcagaagatcagaattcaggccctacctgagccacgaagtagctgtatcgttgtgaagctcttgtcttctccgcttttgtaaaacaggaatattactactctctctccactgggttttttgtttttgtttttaatttttgtttatttgttgttttagagatggagtcttaatatgttgaccaggctggtctcaaactcttggcctcaagcaattctccccagtcgctgggactacaggcttgcaacattgtgctttgctcccattaagttgttctgagcgttaaaaatatacataagagcgttttgtaaattgttattttgttatttttatcacctatagaatgtcaaagaaagaatgaggttctctaaagaatctatgctggaatcgtcttttgtcattgctttttaaatttactcctacagggagcctccttatactacactgcgctttgctcttttttttttttttttcctaagtcagacacatcttcaaagcaacccctgtcattctcccactttgttgttggcaaagagtgccctctgattagtagcgattgcactcatggtaatattagtcattttcacagcaacagccatgccagttgggagttctaatagacattgttttgacttctaaaaaaatcatctttgtgtattacttcggtgatcaaagtttattattcatccaccagcacttgaaggatttagataagagatattgttgagttaatttgtcccttggcctaatggagcctctgaaatataagctagattctcagagtcaccatgaaagcctcacttcattaattgaagaccaatctagagagacgataagaggggagaaaaagaaatctaagctcatcttcccagttagcagtaagacaagagacaggaggtaggaccagaaggggagaaaaattggaagcaacgaaaaaggaaggggcaagccatcctgagctctaagatgtagccattatgtggaaaggcatagctgtgctccataatttcccggaaattaccttttattaaagtactgcccttaaccacattacctttaatattgaaaaataaaaattgctaaaggaactcaggtttcagtgcaaatgtaacagagataattaaattcatcctaattcagtcccaatgattcctgttcaacttcaaatcattgcaattaagaaagcactttttcattcagctcagagaataaaccatagtttctttatgttttgatttgtttgtagctgccattaatagccagtttacagggctacagataagaaaacggagactcgaaagaactggtagaggatggagtagcgattaagattctatctgaataatctaaggttccctccactctgctgccttgcctttctggttccagtaaattccagagaatgtaagagagattattaccaaagtacactaaagaggaataaggagagtgtatgatttcttctgcctttgaggggaagatacatgatttacaaggattctgaatccccagacctccctggtctttgcttaggggagccccagagatggaaatcagttgaagccagacactgaagttctgtatatgcaagactctcaaggtctgggctgccccttcccttcaccctaggaaaacatcaattattcgtcccccaactaggcagggaaatagggaaagaaagagcagagacacagcctgaatcttttctatcaaaaagaaacagtttgaagaattccatatccaataaatgtgtgaatggggaggtgtcgggatgcaaattaaaggcattaaggaacttgctaattggctcaagaaactggaagtttctctcactgacactcaccagctggcccagcaagctgtttattctgtggtgtctcagaggccaggaaaaggtgatacagtgagcccaataagctaagtactgattcaaagatttagaaacatttttcttattacatcccaattaatggtgctaccatccgtgcaggaaaccaaggtagaaagttctcctcagcaggcacatattcaaacacatatatctttccttcttccccccaaaagtctcttgaatctagtcctttctcttcattccacagggcctgctgtaattccacccaccatcatcctgccgttagactccttcactggccacctgtctccctccctccttgtccccttcctcaacccttgctctcctcatgtcgctgtgatcaacactagaatgtcaggccccagtgtctgctgggagggtgcgacccatttggctgatccatgctgtaaggaggatggaaaaataccatcttccaattggttctcaatatccagcttcatcccggaaactgtaagtttaatatggaaaggcaatgaatgcatcagccctcccaagctgatcattcctaaatcttactttgcccatttttctcctccttccaactctgagctccctggaggaaggagccttcccttattgatctcaaggttcagaacgcatagcagaacacccagcctaagataggctcccagtaaatgtttgttcagtagaataagttctctctctcctgagcttaccatggctattagttaaaattaagttgctcaggaagcaggcaccatccatcattccttcctatctagcttcttgtttattcaagagagtcgtggctatgtaaacagtgctgaggcattctgcagtagaggctgtgccaataggggagaggaagtgcattgaatccaactaggcactaatgaaaggctgaaagtccttctggagttttgagggtgtgtgtgtgtgcatgtgtgtgcatgcatgtgtgtgcacgcatgtgtgcatgtgcatgtgtgtgtgtgtttcagcagctttctctgcaacctaggtgtccaggggaaaacagagagccccttgtgcttcctgatttgcaaaccagaccggtgcctttcattgacaggtgttgtgcctagaccaggatgctgttttgattggaaaggatgctggactgattagttgaaacaaaacattctccaattaacagaaatagaagctggagctggaatgtgaagtgttcagcaacagtgttgccaggcagcctatttaaaattaattagaggtagagatacatggaactgaaaaacaccacccgcttccctgcttaagagagctggggtaggatgaatgatgtgggaatttgcaagcgttactgagcgagtctgaactgccttctcagatcccattttttcaattggtggctctcatgcagatgagtgagtcaatgtgtgaaatagaggagagatgactgtgatagagaaggacaaagaaattacaaaatatccctcgctttctaaatgcccttagctcctgagtttgcagagcaagaattcagaaattcagaattcacagagcaagagatacctattactattaataaaggttcagtatatctcatttatctaaaaaacaaaccttggccgggcgtggtagctcacacctgcaatcccagcactttgggaggccaagggaggcagatcacttgcggtcaggagtttgaggccagcctggctaacatgtgaaaccccatctctactaaataaataaatagccgagtatggtggtgggtgcctgtaatcccagcctcttgagagtctgacatacgagaattgcttgaacctgagaggcagagattgcagtgagtcaagatggtgcccctgcactccagcctgggctacaaagactctgtccaaaaaaaaataaataaataaaatcaaaccgtatccggatacaaacaaaattccagaaggaaaagcaaagtgattgctgtaaggattgcacagagctgccaagcattcacccattcaaacaggacctagtcagtccctggaaacttttgcttttcattcaagtctggccattgcaaatcttggctgtgtctaatctgatctggtgtgagttacgaatgttcaaaaggtggaggaaactgatagaggcaggtccatttaaaactgccagaagtgatagcctgtatcccagcaatgcaggagaaggaagcagatgagacctccaaaatgccctctcaaggactcagcgacacatagctgccatttttagtaggaacaaaacaactccacacacctcatcagcatttgaaaacaccccctgaattatacttagaagactgaatatcgaaatatgtatgtgttcatatgtcaatatatgtatatgaatgtatataatatataaatgtgtgtggatatagtcatgctctgtataatgacatttcagtccacagacgtttgcttaagacagtgatcccataaaattctaataccatatttttactgtaccttttgtatgttgatgtgtttagatacatgcttaccattgggttacaattgcttacagtattcagtccagtaacatgctgtacagatttgtagtctaggagcaataaactgtaccatacggcctaggtgtatggtaggctataccgtcaaggtttgtgtaagttcactctatgatgttcacacaataacaaaaccccctaaccatgcatttctcagaatgtatcctcatcattaggtgtcatatgactgtgtgtgtgtgtgtgtgtgtagtgtgtatgtgcatatatacacacacacacatacatacatacatgtagataattcatcagaagttaacacaaatatccatttcattagatcagcagtggcaaatcagctttatctcatttgccagtttcattgcctcgaagggctacctggaaatctgtttgcacaaggactctgatgccaaatcttatcttaatggtaagaagggccattactgacaggaatagcatcatggggctgggcaaggaagcaagccagtctttctttccagctggaataagccatagcccaagaacactgtaaatcgggactattcctctgactcctcatggaattgcttttactgaacaatatgttgacattcccctatgtttgcactgagacgtgttgcattaagaagcagctctattgtgtatctcatacgggtgcttgataactttatccatggaagtgactctcctttaggagaacccatggaagaaatacatccagtgggagagaaaactatttctcttgagaaatgtgtttgttctgatcttctggggaccacagatcctttaattagttacattcctatttttgcatcggctgtggaagtcagatatgcactctcctgtaaacctatgcaggacctttcgtatctattttatctgttcctcttacctgtgacttaattttatgtctctactaatattttccctttgtcctaatttggtcactttatttgtgacttttaggcacttgtactaagtcacctcaaatcctacttgaataagtaacaatcaaggaaacttgtacacttttttttctttttgagacaggatctcactctgttggccgggctggagtgcagtggcacaatgacagctcactgcaacctctacctcccaggctcaagcaatcctcccacctcagcctcccgagtagctgggactacaggtgcataccactacacctgggtaatttttataatttttttttatggtgacagggtctcactatgttgcccaggctggtcttgaagccctgggctcaagcaattctcttgcctcagcctcccaaattgttggaattacaggcatgagccactgcattctagccacatatactttagaaaaacctttttttcaggttagcacctactgagacaagttactttctggaaaatttaagcatgtggaatattttatttcataaatgaagaatctctcgctgtgtgagtttgggatggcgggcgggggtggaggggcagtgtctgtatgtgtctctgtgtatctgtgtctatgtctgcgtgtacaaatgcatgtacaacatccatgtggttcttattaggtcttggaattaaaaggtactctgttcaagctgagtttctcagagccacagaattatagtaattaccaaggccagttccatcaaggcagcagagtcacacacgtttcaaatgaacagacaaagggagcctaagccactgttagaaatgtgctgcttattaatggctgcaaaggaaaattcttttcctgccttggcctcagaatgcaaggagattaattcttaacaatgaaaagacaggcagctgtcagcggcttgtcacagctgggcatgtgatgaagagagaggtgctgtgacatgtgccagcaaggacaggacttatgcagtggagaagtagggaaacagcctcgaaaatagggcaaagggagaggacggtattaaagtgaatgccactctatgtgcctggcagtgttttaggcactttttagaaattccctttaagcttgcacactcccaaacgcttcccatttgatggataaaaacggtgaggaacagagggctgaaaccccctccccatggagccaggatttaaacctaagtttgcctgactttccaacccatgccactctcactgtgccagtggccctcaaagtgtgcactgtgaaccacctgagttggaattcctggggagctttataatgcagattccgggacctcaacccagacctgtttgttcaatcttcgttgacgtctacaagcactaaatcttcagagccaccactgtaccttgcagcctgttaaaagtcagcagttccttgccacagtggtgggctttggagagttctcccagctctcaattcctccttcagcaggagaccctgcaacctgtgtgaccccccgaacctcggcttctggaggacaattctgaacatccgttaaaaggaataactttggctgggcgcagtggctcacgcctgtaattgcagcatattgagaggccaaggtgggtggatcatgaggtcaggaaatcgagaccatcctggttaacatggtgaaaccccgtatctaccaaaaatacaaaaaattagctgggcatggtgccgcgcacctgtagtcccagctactcaggaggctgaggcaggagaatagcttgaaccctggaggcagaggttgcagtgagccaagatcatgccattgcatcctagcctgggagacagagcaagactctgtcatggatgaatgaatgaatggaataaactcaggggcccagaatcaggtcttaaaatcttggtccctggaaagattgatgttaacaaaattaagccagcatcctcacctatcaggttttttctactctctgttggacttctgtagaatttctttggtatttttcagaagccagcctcctgcctagtcacacagctttctcctccgggcctcagtttcccaatctgtaaagtgagggagatggacaaaggcttctcccaagcctgcttctttctcaaagttggtacccagggtggcttcacacagtttttgaaaacaaagtgccttcactacactggggagagaggaaaacaaaacaaaacaaaacaaaagctgctgtgaaaaccatcccaggatagctcatatgagcttagcagccgacacactggtgtgtacaggacccatttgtcaagctgactgtctctccacaagcttggatttctccctcatggtctggggtctgccttccccccctcccttcccccagtaaagatgaggaaatctatttatgcagctctgaaactagacacacaagaagttgcatccccactggttcttaccagctgtgagacactgagcaactgattcaacatctctgaacctccttgtctccatgtgtacataatacagatgtcagctggcatccccctttctcccggagaagctatattgactcagacacccccgagtcaatgttgtggtctttgaaagtctgaaactcttccttcaatatttgctattttctagggcttatgatctggaggttttcctcatgactgcaggcaggatctctttttcatgcaggaccaccccagcatcaagctcagcctcttcactgggtcccataagatgcccctccctggcacacatatcaggcattttaagctttagtgtatgagagccgggaatgagcacatcaaaatgcacaaactcccagccttctccaagcttccacccacttcttattttccttcctccccactgtttttttttcctgagacagagtcttgctctgtcatccaggctggagtgcagtgacacaatctcggctcactgcaacctccgccttccagattcaagcgattctcctgcctcagcctcccaagtagttgggattacatacgtatgccaccacacccacctaattttttgtatttttagtagagacggggtttcaccatgttggccaggctggtcttgaactcctggcaagtgatctgcctgccttggcctcccaaagtgctgggattacaggcgtgagccaccacgcctggcccatttacccttattttcatatcccctcaacccagactccaagaccttcaatttttccccctctgtctagcagggtaatgtctcaagaatatcagcaaataaattacctaagccctgggtagagagatagccagctcagtctctgtaccttttcattttactaaaggatttctttccaaatacatggccctttccataagaattaagatatgtaaaactatctctgtctaatagtgtatgcattaaaggtaagaatactcacccacaaggcttttgagaacatgggtggtccgttatgtaaagctcctcatggaatgttcagcttataggtagtcctcaaaattagtagcttttgccttccctaccaccaagcaatggttactgccagggcacactagggtcaggcaagcaaggtacctagtgtacacaatttaaggaggcactcactctcaggttcacgtgcagcctggagagtgagggcctccttaaattttacaccccctggtctttctcttgcctagtcctggccctggttgcagaattggccaaaccatctaccccttctggttatctgaatctgacaaatgtgaatttgatcccagctttaccaaatagtcactaatttcacctcgatcaagtggcttgagtttcagcctaccatttacaaaatcaagctaataataccccttagtggaaagggttgtttcggggtattaaagaggtccatatatgcaatggcgcttcaatcaatattgcttttctctgcccagagtcaatataagaacaaaagattatttcagctttccacgttctagcgttttcactgcttcctttaataaaatgaactcagcaggagatgagactagctagcccagaactgtttttacagtttcccttcctaaaatcaattttgcttttccctcgttctgcagatgacgtaaaatctagagagactacaggaaattgaaagaataaaatagatggtgatcctgcagagttgttgctgggttacagaaaagtgccttttgagaaatctaccaaacaacataaaaagccagaagcagcatcttcctttaattccccccacctccccctgcttctggctttgaaagtccttgaccatgaagctgcctagatgctttattgggtccttgagtgatcaatggcatgtatgcatttgatcctttactgctgataatctgtcattaaaaaataggagtcggggccgggtgcggtggctcatacctgtaatcctagcactttgggaggccgaggcgggtgggtcacgaggtcaggagatcgagaccatcctggctaacactgtgaaaccccgtctctactaaaaattagccaggcatggtggcgggcgcctgtagtcccagctactcaggaggctgaggcaggagagtggcgtgaacccgggaggcggagcttgcagtgagccgagatcgcaccactgcactccagtctgggcaacagagtgagactccgtctcaaagtaaaaaaaaaaaaaaaaaaaataggagtaataaaataggagttgggccaggcacggtggtgcacacctgtaatcccagcactttgggaggctgaggcaggcagatcgcctaaggacaggtgtttcgaaaccagcctggccaacatggtgaaaccccatctttactaaaaatacaaaagttagtagggtgtggtggcaggcgcctgtaatcccagctactcaagaggctgagacaggagaatcgcttgaacctgggaggcagaggttgccatgagctgagactgcaccatgcactccagcctgggtgacagagcaagactccatctcaaaaaaagtagaagtaggggtaagagctaaaagatacggtggttgattaaggacatggaagtgtggccaggttttctaaagagtatttcaggataaaaactaaggttgacttcacagtcctcaccaacctctatgccccactaatgactcttctgagcaaatcactgccccctctagaactctggctgagcctttgtttccagcactgagacacagacatgtcccattccgcttgcagtctcccttggtggggacaccctccctccttccacatgtgacctagaaagagactctggcttcttgggccactctatcgtggctacccctgaagttagaaatccaccaatcacttcctccagattgtcaaggaccattacacatttacatatgctacctctctggttaggaatgtagaagacaacataacagtcataggctatttcctgaggaattagtacacatcaacactgttatggcccggcgcggtggctcacgcctgtaatcccagcattttgggacgccgaggcaggaggatcaccaggtcaggagattgagaccatcctggctaacatggtgaaatctcatctctactaaaaatacaaaaaattagccaggtgtggtggcgggcacctgtagtcccagctagtcaggaggctgaggcaggagaatggcgtgaacctgggaggcagagcttgcagtgagccgagatcgcgccactacactccagcctgggtgacagagcgagactccatctcaaaaaaaaaaaaaaacactgttgggagggctttgcatatagtgagtactactgttgtccctactttacagatgaagaaactgaggctcagcaactagtaagaagtacaaacaggatcaaaaccaattgatccatctccagaatctgcactctttagccactagcttttgctgtcatcctatggccaccctaggtacacccattcatttgcatcaggccgcctgtcctgatttgcacctcaaaaaaattgaaaaactttggccaggcgcggtagcttttgcctgtaatcccagcactttgggaggctgaggtgggcggatcatgaggtcaggagttcgagaccatcctggctaacacagtgaaaccccgtctctactaaaaaattagccgggtgtggtggcacacgcctgtagtcccagctactcgggaggatgaggcaggagaatcgcttgaacccgggaggtggaggttacagtgagccgagatcacgccactgtactccagtctgggtgacagagactccgtctcaaaataaataaatataaataaataaataaacttttcaatttcctttgaaaattcttaccactagtatccctgatctacagttctgactctctttctgcatggaaatcaaaagtcatttgacctctaattcaatccttcccattaggatgggatgcctcttccatacaatatcagaataataaaacaatgcagtatcttcagtgtctactgggctcaagtgggccattttcacagcaggccttattgacaaagtcattttaatattgtttagttcaatcaaagaccccagagctggcctccttttgtaaagatgaaccagagcaagacctggctctggttcatttgtgacctgagaagtcccagggaagccaacatctctctggtcaccaggcttccctctagcaaatgtgtgtgtggagaatgctaaatgagaaaaattacataattgcttaacacacttgtaaaaactcagctgtttgctaatcctgctattgtgactgctattatttctctcttatgattattccatcatggttgggggagaattcagggatggagggagatggtcactcatcttttaaaagatcaagtattgagatttttcataacactatcctgtgagagacaaaagtcatagctgaatcttccataactgtcatctcagaaaccgctatcttggatgtgatgtgacaaccaacatttcctcttaaataaggcatttgtagccctccccttgaccatagtgatatttaaagaaatttctgtaatcaaggaaataagatttgaaagcaagcccctcgtaaatgacgtgtttcatattactcaccaaaatcagtaacaaaaacaattacacaaaatgtcttaaattgatgggggtgtcaggagagtaagaattttttttttaaatgactgttgaagtcttctaagtcactgtgccagtatgctctattttcgtttgtttgtttgtttttgagatggagtctcactctgtcaccaggctggagtgcagtggtgcaatctcagctcactgcaacctcccctttccgggttcaagcgatcctgcctcagcctcccgagcagctgggactacaggtgcgcaccaccatgccccggtaaaagtttttgtatttttagtagagatggggtttcaccatgttggccaggatggtctcgatctcttgacctcgtgatccgcccccttggcctcccaaagtgctaggattacaggtgtgagccaccgtgcctagccgctctattatttttatgctgtgtgatactgatgtactttgaatgctctctatttgagctctgcattctctggattgatggaacgcgacatttttctttgtctccagaaattccccctctccttcaataatgagtctctagacttagtactgcctgaacagcgggatactctcttccaggcagggatcattagtgaaagattggcaacattttctcaacactggtagaaagaggagttatatgagccctctgtgcatgtgtttttaggtacatgtatttgtattaggccctagggagtttcaagacaagctgaatttccttcagtgtttaatacttcataaataaagccttattagcaattctcagctccagcaaatcatggatgtattccagagaacatttaaaatataaatgtaatttcaagtggaagaaaagagccccatttttccaaatagtcaacatatctcaagacactaacattttcaggacggagagggtgacagatagggagtcagatgggaatgctttggtgagatagagagccctcacagaaagaaacaaaggccactctccccctcactacatgcttaaatactcacaaggtgacatgaggtaggtgttggaattatccccattttatatttgatgaaacatttacaggttaagcaaactgtccgaggagacccagataataagtggaagaactggtatcggaagttagcacagtaactcaaaaactgccctctggctgggtgtgtaatcccagcactttgggaggcctcagcaggattacttgagtggaggagtttgagactagcctgggcaacacagcgagttctccaagtcactgtcctcttcaacatgatatatttttcttcctgcgtgcctttccagaaaagatgtcttatttccaaatgaacctccaaccaatacccatagcccatactccttatcccttttagaaggacctaccttccagcccaaacttcgtatccttcttgaaacaaaccacccacacccctctttccagcccatattccatgtcttccttggaatgaaccacaagcacccacccccaacacatattccttattgttgttgagatgaaccactgaattcgacccctagcctgtattgtctgtctttcctggtcatgcatggcctcagtgaaagccactaggtctctcccatgagtatcattactgatgttctttggggggacatggcttagctgtttccaaacaatggccaattccacctaccccatccattgatcctatctcttacctcggggagaagggcccacaggaatttagtctggccctgtcctttgaatggctctctgcagtggcaggtaagactggtacggaaggaggtgtgaggtagataacccctcgctgaatcaaactcaaagagactctcaatccggactcaacgttcttgacaggttccagggcccgtgccccgcttatatctcaaggtaggttccgtagcactcaataaaaccctctgcaaggtatggatcatcatttggtggttggataatcctaatctcagggtgttgaaagcccccactgttaagaaaaccttcagtcttcttcccaggaaatggacatctcctcttggcctgctccaacatgcagagttgttcaagggggcatggagagaacactgttctctctcctacccagtgtgtttgtcattctggaaagagcaggtggagaaaagcaggctgttctcttgacactgcattctttctggctttacactaatttaatctaagacacaacattcaacataattcattgagtagctaggatcttccaggcgctgtactaagaatcttaaattttatctcatttaaacctcaaaactctaaaggtggataatggtaccctcctcattttacagatttagctaaaaagtaatcacttgttcaagagtgcacagccagtcagttagtggtggacctgcaattaacacccaggttattctactccacagccaatgtcttaatgctcttattagattgcctcctcgatagaattatgactctcagaagaagttttaataaactttctttcattgaacgacgtgggtgggcattaggcagcctagctttatataaaatgacgtcagcaccctcagaatgaaagaatgttggaaatgaaaggctctaggctttaactgtattagtagctccttttaaataaggaaactgagacccacaaagaaataactcagccaagatcacaaattttacctctgggaaacaaaagcagcctacatagaaataacttttacatcagatattccaaaatgtgtttcatggaggagtaaggtctgtgagatgttaaaaatagctcagggaagggggaaagaagggttctgtggtgaaatactatattttctgatgtgtaaaattcaccagttatatgagacgtcacccaattttatacagaaattatatgcaagaattacttttcatcatacgttttaaaaagtgattttataatggaaaattatttttgtaagcatggattgttgtacagtggaatcctagtaggaaataatgaagtctgaatatgtagtgatatcttataagcccctaggcagggggcaatatgaaaatcacacagctggaaaaatatatattgatcttactaaatgctagcacatgctagagttagtagggttagtagtaattatatttaagttcaaagtgttaggggaaaatcacctaagcaactatgtgaactttgacttgctattttttataggaaaactttgatgtactgtgaaaacattgtatctttactgctatgttttgggattgcctgttttaccactaagggagtagacatgtattattttgccttggattttcattcattcatccacgcctgagcatttagttcatgggaatgtttggattcttattctttcatggcaaggaaggaaatgcattatataagcctgaaatacagtaatttttttttttttttttttgagatggagtctcgttctgtcacccaggctggagtacagtggtgcgatcttggatcattgcaagctctgcctcctgggttcaggccattctcctgcctcagcctcccaagtagctgggactacaggcgcccgccaccacagctggctaatttttttgtattttttagtagagacggggtttcaccgtgttagccaggatggtgtccatctcctgacctcatgatcctcccgccttggcctccaaaagtgctaggattacaggcttgagccaccactcccaaccaaaatacagtaaatttttaaaatgccagattaaactaagttagataggtttctttcctgcaggacttcttgttgacagagtatacagcattttcctacttatttgactgtggaaactcttttcttcatatctcactgaatacaagttcacaagattttggtgtcccatcctatatcccatcagattatcaaatcgtagcaacacaatatcttacacttgagagaaaagcaggacagtcctttatgatttggtacctgcagtagaaacagagtgtctggtgaaaggaatgccacctcctaccaattcagcaatccctgagatccactcatttgtgctggccacagtacctccaagcttctcttcctctctgttctgcccacaaacctgcattcttgcctgcctcctggattcacagaaatccaaagggaaaaaacaaaggaggtctttctttaccaggagtgctgagatagctcgcaggagaatgaatggtaggattcaagcatgttagaactctacagaaacagagggacattggtatgattccaagcacttggggacaattctcccccacacatttcattggctagaactgatcgcatggccccacctgactccaaggaggctgggaagtgaagtcttcctgagtgtttaggaaaaagagaaccagatatggaaaagtacaaatctttccacctcaggaccctaagttcttagtcattccagtgtcagaagaaattaatgtgatggaatacttcaactatcactccttgaagtttcatcactctctctcatttggacttatagtaaacccctatcttagttcccattgtcgcctaagaaaacaatagttcagcatggtagagtaacttgtccaaggttcttttagctaataagtgacaaagccagactcaaacccatatcttcctgactccaaaaactgtatttaccttaaacagttgttgtgaggattgattaaatcagaaatccattcattcatttgaatattcattaaacacctacctgaaccatttactagtcagtatgtagagaatttggcagacactgctctcctagaatttaaaactgtatgaggataaaataacaaacaagaaaaatggtcaaataatttcaacaatggaaaaatttcagaaagaaaaataaaataagctaaaggaatggagtaaaagggatggggaaggcaggtattttgaataggggagtcaggcaaagcctgaagaggtgatctgaggagaagaggctgaagcaaaggaggagaggtcttaagcagagctggaaggagggggattaacaagtgcaaaggccctgaggtgacagtgggctgggtacatttaaaaaacaacaacaataaggcaaatacgactggagcaaggaagtgaaggggacaacagtaaatgaggtcagagaagtagtcagatggcacatagcctaggtcagagaagtaagcagatggtgcataatctgggagagggaggcacaatcgggaatctggaaaatttctagccatgatgggaagaaacccactggagtgctttgggcgatggaatgacgtggtctgtgttctttttcttaaggttccttttctattattatttctgtgcaatagactgttctgctagagggaggagtaagaatagaagtaagaagaataattagggagctactgaagtcattcaagcaaaaattgatggtagcctggataagactgttcaaaagagaaggtgaaaagtcattagattcaggatatattctggatgttaaaccaaccagatttattggcagattggacgtaaagattgaggggaagaagagaatcatgaaaaacccctaggtttttggcctgaagagctgtggttctgtggttttggtagacagaatgatgctccccacacccccaagatgaccctgttctaatcccttggacctgtcaatatattactttgcatgaccaaaaggattttacaggtgtgattaagttaagagccttgagctggggagatttgagccaaggaatgcaagcagaatccaaaaaacaaacaaacaaaaaaaaatggattcttccctagagcctccagaaggaacatggcccagctgacaccttgattttaggccaatgaaaaccattttggatttctgacctctagaactataacataataaacccctgttggtttaagccactaagtctgtagtaatttgttataggaaccatagggaactaatttagtgggatgtgaacagtgccttgaatcttgttaagacactaaagggtgatcaccacagcaaactaggagttagagcagagaacagagggagacagggtaggtttactgttcaatcttaaaatggaaaagtacttaattgtgtgatatattgagtttcactaacaagcaggaagtaccaatttgtgccaggtcttatatcagacaatggagacatgaggatgagtaagatgcagggcccggtctggtggatgaatttgcaggatggggaacaatttcacagcagcttaatggacctgcctgtcattttaccttgaaaagggaccctagtctagttttcatctttgagtataggggggataaaaaggcctcttggtgctcgatttcctctggtaccacggaatgtttctttgggcaggtctcttctgtcttttacatctgacccacaaaatgcactttattccacttggtctggactttctattgaaaccagcaaaatgatttacagaatgtacagcatctctgaaaaaaatagtaaaagattcattggaagagtgaaatctcttttaggttgtaggagatgtctcttcactcatctgatatgatacagttttaaagtgataattgagacttttttatggagtgcagttaagaaatgtcattactgtttattacagaaaatgaaataaattggtagtgcgggtaagagaactcatattgtagagaattacaactctttgggaaatacgaggtgagcatcttctttgggcacgagaattttttttcaaataccttccaattagcacaagccttgtgctcagtatttcctccactccccattcaatgacggtttataaaaaaaaaaaaaaaaactacccttattccaaatttaagaggcagagagagatgggggcggtggcggggaagggagaaaaggagaagaaaggagtgagagggacagagacggagagggatgagtggggggaagagagagagagagaaggggaaaatgtgggaaagaggttcagactggttggatcgtgtctgcagtgattgctgactgcagggttgcacagtagaccagcactggctgtaatgttaagctggccagaatttaaagctcatctctggcataaactacctgtgtgaccatggacaaaatatctaaaccctatgagcttcagtttttttcattcattaaattggagaaatgatacctgtttgcagggctattgggaattctggtgtgatcatgtatctgaagtacccggcattgtctaaaacatggtagatgcctaataaatactcacttcattctccagagcatcctgcttctctctcgttctctttttgacactccttaattttcctcttttgagaatcagtgatacatacctggggagaaaaaaaaggaggtgggaagaaatgggaaggcatgataaggttgtggggagactatcgcaccactgacttttcttataacttcccaggactggctggggaaagacctggtaggtacagggggagccatggcctggaatagcaagctggacattcctggttatgttactatactgagacttaaggctgcgaaacacttgtccatcttcagctatatttcttcctcacttaaaccctctgggacaattttccactttagagctaaagaaactgaggctgggagaggctttctgacttgcccaggatgactacagtgagtaaggggagcctcagtctcctcaagtcaccacgcaggcagccctttctgcctcattgcacctggcacccacctttatgtaaaagccaacatcaaagaaaacgacccaagtgctgggggacttctccttaagtcaactaaagatgaggtccttgtcacatggccacgaaaatgtaggcttgcagacgattcgaagagtgagaaaaatgggatttactcggcaaaaaggaaaaaaaggggaaacagagactcttagtgaagcgagagagcgtgcttcctacctgtgcacttcctgcctcacagtttgaatcccaggttccacacaggaagaggaggggccaggctcctccctgctgcaaacagcattagttactgtggctccatcttgtaaggattaaagaaagaggagaggaaggagagggaggaagagggagcaagggttagggagcaaaatcccacttgcgagtggtcaggggtggattcctaagacctgagggtttgtttggtttcttgtttgtttgtttgtttgtttgtttgtttttgagacggagtctcgctctgccaccaggctggagtgcaatggcacattcttggctcagtgcatcctccacctaccgggttcaagcaattatcctgcctcagcctcccgagtagctgggattacaggtgcatgccaccacgcccggctaactttttatttttagtagagacggggttcaccatgttggtcaggatggtctcgatctcttagcctcatgatctgcccacctcggcctcccaaagtgctgggattacaggcgtgagccaccgcgtcctgcccaacctgagggttttgagagcccacctgggagtagccccagcctgagcctcacagttcccttcaggttcatcgtcctcctcacgcaaatcagttgaaaatgaagtgagggaaaagatgggcgggtggccagagaccttcaggatccagaggttaactcacagtgagccgccgttgcccactgcttcctgagttgcaagagagcctgtgctcccaacacccattccaggttttggcaccaaatgtaagaattaaagaaagaggagagaaacacgaagggtggcttgacagttacccaagagactttcccccactacctccctttgtggccgagctgttttatttgtgttttactatttgctctttctggctgcttatagttagaagagaagtgatttccttgtaatgcttgaggctagaaagggagctggaacttaaagtggtgatgcttgtctgaaatgacggtgctcctgctctgttacatcccagtatgcactcctcccagtgaataggccagttggagttttgccagggggcccttcccacctgactgtctcacaaattctcagaccgggagaaggacctccttgaaaaggcgagttgaatcccttgaattacataaggggaggagataacctgagccttaaactcacagtgaagcccactagttgggaattcagaagagacagagagttgaaaattaccgaaggaaacttgcccaaatacttaagatagaatcacagtgctctgaaagaatatgctaagtcactgtatttttaagaactgggaaaacgtgtttcctgctactatttggaaagaatgactctaagagcgtaaagggcaaaacccttctttttatgagcactgtttactgttgctgatacctcctgactaaatagactgtgtctacatgtggaccacttgggaccagttcctgagctccactttggacctaatgaatcagaagttattagggatgggccccagagttttctgttttaatatgctaccatagtggccctaatgcacagatgaactggaaaccactcttctaaatgtgtcttatgtctcccttgcctgctggatcctgattcaacagatatttattgaattccaactatttagctgtctgtgttgtatgcacttgggatatacctataaacaaaactgaacgctctgtcaaaaaaatctgttttctagaacttatagtctactgtgtgggtgacattgtttaaatatgtgtcctcatcaaatctcatgttgaattgtaatccccagtgttggaggaggggctgggtgggaggtgactggatcatggggattagcaccattccctcttggtactgtacagcgagttctcatgagatctggttgtttaaaagtgtgtggcacttccccccttattctctctgttgcttctgctctggccatgtaaagacgtgcctgcttcccctttaccttccaccatgatggtaagtttcctgaggcctccccggaagccaagcagatgccagcctcatgcttcctgtacaggctgcggaaccatgagccaattaaacctcttttctttataaattacccagtctcaggtatttctttacagcactgtgagaacagactaatacagcaaaaataggtgagtgaggaaagaaaataagcaataaacacaacaaatcattttttactttatattaaaagatcatcattgctttttctaaagaagaggcagataaaaggggaaacaggagtgtggggatgggagagaggagtgggttgggtggtgtgaccctggatcttctgtctactccaggaatgagactttaaacctttcctgcctgcatcaacctggactgctcagatctgggcttcccacttctacctgcctcctgattctcagtgctctgttgccctgttagttcctaggtactccacccacagtgcacggaagtaaccttcctctgctagctaaacagaattcgtgacgacctctccaggctaactctgggaaaatgcttgtttaaacctccctgtaggactaaacgcttaaccaattctttgaaacaccagaaagactggagatatatttgagcaacactctgtggggtgctggagccagtatgcacgagctcctgagagccaattgtgtgcatgttttttccagctaggcatcagtggtgttatatcatagctcaaaccagtggggggccggaggcgggcggggtggggacggtgggagtagttagttacactgagaactgtgataactcagcaagtgccacaaatcagggctccctttagagatctgttgttacatattgaccatcacatcagtggtaacagttatgtgctagaaatagccccagaagaacataactccaaagctctctccctaaatccagtaacctgggtttggctcttctcttgcttcctgggtacaagaaaatctcaaaccctcttgctaccgaagggtttgagattctagaccaaaaagatacacagagaggcttggaataaaatagacagtagtgacttgaaggaatacaaagggtgaaaaattcctgcactcaatttattgtcttatatcttgaggtttatttttcctaataatcattacaccctcagaaactgatgagtttccagggcattataaatttaaaacatttagcagggctagcactaaaatagctcattaaagagtgtgggttggaaaggcttgttagtctgctttatatacaatgatcaattacagcaaatttctcagcagtagtttctatcactcttctttaagatgcagtaatagaaatgagatcatcagacttaaggaagttaatcagtgcatcaaggttttccacagaaattttccaaggcaggagaaagaaaatggacattccagatgcctaagactatggtttaaagagtctcaacaagctcaaaatgtcaagaaagctttggccagtgatacgctagtgaatgttttaacaagcaaatcttaggggtggggaactgtgatttacagcatttgccaacttccattgcatcaaaatttccaccatggccaatttcaagctacaaatgtgctatcaactgacttactgtattcctgaaaatgtagctattgattctcatgagcttagtacaagccaggtctaacataccacttggttttttttttttttttttttggagacagactctcactctgtcttccaggttgaattgcagcggcacagtcttggctcactgcaacctctgcctcccgggttcaagcgattctcctgcctcagcctcctgagtagctgggattacaggcacgtgctaccatgcctgggtaatttttgtattttttagtagagatggggtttcaccatgttggtcatgctggtcttaaactcctgaccacgtgatccgcccgcctcagcctcccaaagtgctgggattacaggcatgagccactgcgcccagccccacaccactgtctttagctcaaaagttaatatgaattttgcacccagctcaatgatacatccataattaatttaaaaataatagtggttttctgtctgtcttcaaattttccagcatcacctaatgtatgtttcccaaagacagctctactcttatgtgagatgacttggtggggggctgggacatggaatagccttacattgtttcctttgcatttctccctctcaatcttcccaattatattaagattaaagtctcagtgaggtactaatctgctttaacacctcttgaacacatccctctcccttttcaacaaagagggagcaggcttcaagttcagagtcttcaggctggcaacagtatcaagttagaatgtattagaattgtttctttacattttgcttattatgttcagctgtctatggcaaataatactgatttttttcccatttatggatgcagagtgggcttttcctttaaatatgttattagtatgtcagttaatatgtttcttgtactaaggtggtacctggaataagcaaaagtcacttgcttctcagaagataaggcccagcttcttgtgggacatgctagtggggccttttggaggcagaaatacccagtggcagcttgttgcattagcagtaactctctacctttagaatctcctgctgccattcatcctactcaccgaaacagattttgattcaagttatgatgtgctgtcatatgttgatttgtatcagcagttgctcacttgtatctattgccaatttccatggtgtaaatcttcccaccatggctgatttcaagctatcaaccagacaatgaacatatgcatgcatgtatcttcatgacagaatgatttatattcatttggatatatacacagtaatgggactgctgggtcaaatggtagttctgtttttagctctttgagaaattgccacactgcctttttttgagagtcttgctcttgtcacccaggctggagtgcaatggcatgatcttggctcgctgcaacctccagctcccgggtttaagctattgtcctgcctcagcctcatgagtagctgggattacaggcaccatgccaccaagcctggctgatttttttgtatttttggtagaaacagggtttcaccgtgttggccaggctggtctcaaactcctgacctcaggtgatccacctgcctcggcctcccagagtgcccagattacagacacaaaccaccacacccagcctgccacactgctttgcacaatggttgagctaatttacactcctcccaacagtgtataagtattcctttttctctgcaaccttgccagcatgttatttttttactttttaataatagccattctgactggtttgagatgatatctcattgtggttttgattcgcatttctctaatgattagtgtattagtccattttcacactgctgataaatacatacctgagactgggtaatttacaaagaaaaaagaagtttaatggactcacagttccatgtggctggggaggtctcacaatcatggtggaagatgaaaggcatgtcttacatggtggcaggcaagagataacttgtgcagggaaactcccctttataaaaccatcagatctcatgagacttattcactatcacgtgaacagcacatgaaagaccctcccccatgatttagttacctccccctggttccctcccacgatatggaaattgtgggaactgcaattcaagatgagatttgggtggggacacagccacaccatatcaatcagtgatgttgagctttttttttcatatgcgcatacaattgtgaagagaggagaattctttgaatatatacacagtaatgggactgctgggtcaaatggtagttctgtttttagctctttgagaaattgccacactgcctttggagaaacagaaatcttgcatccatagttgcctcatttctctttttcaattactgactctcccaacatagaaggatcgagttgagggaggccacagggtcacttacatgtgcagatagagcagtggtttgaattcagtaaccaccctgttttttgttgttgttgttgttttttgttttttgtctttgtttttttgagacagagtctcactctgtcacccaggctagagtgcagtggcacaatctgagctcactgcaaactccgcctcccgggttcaagcgattatctcacctcagcctcccaagtagctgggattacaggcacccaccatcacacccggctaatttttgtacttttagtagagacagagtttcatcatgttgttcaggctggtttcaaactcctgatctcaggtgatctgcccgcctcggcctcccaaagtgctgggattacaggtgtgagccactgtgcccagcccaccctgtattcttttttgtttgtttttttgagatggagtctgcctctgtcgcccaggctggagtgcagtggctctatctctgctcagtgcaacctccacctcccgggttcaagcgattctcctgcctcagcctcctgagtagctgggattacaggcactcaccaccacacccagctaatttttgtatttttagtagagatggggtttcaccatgttggtcaggctggtctcaagctcctgacctcaggtgatccacccgcctcagcctcccaaagtgctgcgattacagattacaggcgtgaaccaccgcacttggcctattttctttttctttctttttttttttttttttgagacagagtctcgctctgtctcccaggctggactgtagtttcccgggctggagtgcagcggcaccatcacggctcactgcaagctccacctcccgggttcacgccattctcctgcctaagcctccctagtagctgggactacaggtgcccgccaccacacccggctaatttatttttgtatttttagtagagatggggtttcaccatgttagccaggatggtctcgatttcctgacctcatgatccgcctgtctcggcctcccaaagtgctgggattacaggtgtgagtcactgcgcccgacccaccctgtattcctaaagtagccctagcattcactagctgtgtggtctcagacaagtcacttagcctctaaggaatgaaatttctaggagcacaagagcatagggctctcacatagcatgtggcagttattaggatgcaattagcatcaccatttctttcctccacacccacaggtgtagaaccagggcacgtgagcattgtttaaaggagagcttcaaagatgatgtatctttagagcttgatgccacctgcctttgcctacctgttgcttggctacagacctggctcccctccaacctcccatttctaacgctacatcaaaggctgtgcttctcagctgggagcagtttcgtcctttgaggggcagctggcaatgtccggagacatttttgattctcacaactggaaaagtatgactgggatctagtgaatggaggccagggattgtgctaaacatctcaagatacacaggatagccccctgcaacgaagaattatccagccccaaatgtcaccatgccaagaataaaaaaccctgctctaaggattaagtgagcttggtccctctaaaagatgtgtttactctactggaatactagagaaattccttaggctaccatcctaagaaagagtagcatagcccctaaaaattgtaactaaattttacactccccaggcagaggtataaagatgtctccgacttgttaaagcaataaatgaccgaaggataatgggcatgacagaatagatttttaacagtcttattcccatcattaaatcctcgctcttccacttttttagctctgtgaccatgagcatagtaagtgctaggatcctcaatttcttcaactgtaaaaacagaaataatgcacctgtcttgtataaaattgttgtgaagattaaaggagataatgcctgtaagccagttagccagttactgctggtatattgttatgttctcaacaaacataatcattatcatcattactcttgctattatactgcctacagtagtcagagctcaaatagatattttcatcattattattattttaggtctattttagttccttaaacagttgtgggtggctgagaggcacatgtacctgtctcttctctgtgccaagactctgcagagtggtgaacggcaagaaaggaaaagagtccaaacagatggaaacttcatggggcaggtttctcctagtctgccccccgccacacacacacacagaaactaaacactcttccaagctgtcttcatccatgggataatttctttaaagcctgcatggaatcccagataatgaagaatgatgaggctaattatagactcaccatggtacaaaaacctgtcggttgtatgttcatacagattatccagcttaagtcacaggccattcagagtgttcaatttcagaaccatccagaagctatcagacctagtctgtccaatctgtgggggcacaaacccaagaactgttctagcacatagaagagcacaaaaaacatggcttgtggtatctgtgcttagtgaggccactgactcacttggaatggccaattccagattgcagaacttttttttttttttttgagagagagaaagagtgtgtctcactctgtcgttaatgctggagtacagtgatgcagtcatagctcaccgcagcctcaaactcctaggctcaagtgatcttaccacctcagtctcctgagtaactgcgattacaggcactcaccatcatgcccatgtaatttttatatatatagtttttgagacaggctcttactgtgttgccaaagctggtctcgaattcctggcctcaagcgattgtcctgcctcagcctcctaaagcactgggattacaggtgttagccaccacacctggccagaacttttttcaattgttattttctcctgataagaaaagtagcacatattcaacagagacatttaaaaccatgtcccttcaaagcaagaaaaatcatactcccattaccaacagtaacccttttgtatgagttgtcttttctttcagtatttcctttttggacagatggggatttgttctttgttttgttttctttagtggcttgacttttttttttttttcttttttttgagacaaagtctcgctctgtcgcccaggctggagtgcagtggcacgatctcagctcactgccccctctgcttcccggttcaagtgattctcctgcctcagcctctggagtagctgggattacaggcgcatgccaccacgcccacctaatttttgtatttgtagcagagacagggtttcaccatgttggtcaggctggtctcgaactgctgaccgcatgatctgcccgtctcggcctcccaaagtgctaggattacaggcgtgagctaccacacccggccagggcttgccgttttttagacattatcacattgtacaaaaaaatttgtggactgcctttttttccctcttgtacactcataagcattttaaactataatggctacataatattctaacaaacagctctaacagagtttactcaaccactctcctgttctggacatctaggttacttgttcttttttttttttttttttttttgagacagagtctcactctgatgcccaggctggagtgcagtggtgagatctcagctcactgcaagttccgcctcccaggttcacaccattctcctgccttagactcccgagtagctgggactataggcacccgccaccacggccagctaatttttgtattttaagtagagacaaggtttcaccgtgttagccagcatgatctcgatctcctgacttcgtgatctgcccgcctcagcctcccaaagtgctgggattacaggcgtgagccacagcacccagcccgagaatgtatcttaaagaaataaacctctacttggaattttatttaaaaagtatttatatctaaaatgtttgttgtagctataccaacaaaaatgaacatgtcactctgggaagatgtgacttcaattgattcttagaattgccacctacctccccaacttaccaaactcttggttatggagacttcttagattcacccttccttgtgactctagaggacctgactactgttcatagccacccctctgggatcagtcccatttgagatcccagtgaagcccaggctgaaacaagaatggctgaagtctggctatccatccctagttggcctctgagcaggaatggaaagttgctggaaggcaacacctccctcaaccccttactttaattccctgtctgttgagcctgtttttatctcgttaccatggcaacacagcctcaaggctgatagatattccttgccacttagaggaaaacactcagctaataggcaagtgggaaggacacaggaaagaaagggtgagcccttttctgtttcccttccgtgcctctgcaaatgggcagagataattaaaaattagattttaaagtcacactgacactgacggaaggaacataaggaggattccagcgctcacaagaccatctgcttctagtgctaattaaagtggatgaagataaatcaaattacctcagatctcatgtctccttgatgaagaatctttgaaagcataggtcattttagggactcttttcaccctttggggaattacctggcttctaaaaaacctgaagcaatcgtaaagatcaagtgggttttaacagcatgtctcagcatcctacctcaaatcttggtctcaccccgccagcctccataattcccagttgtcattggtctcccagtttctccccatccagggcccactggccaatattactctcagggttatcttcccgaaacacacttctagctgtgtccaagtgaagaccatgcccagctccctcctgctcacataagaggggccagctgacctggcccagcacacaacatccccaggacacccaatagcactgtcactcacgcccagtcccctgaatgagcaatgcattcagtcctttcagaactctgttctcttgcctgagtgtatgcagtttctcttcctgaaaaatgcctacctccctctgtttttgaggtggagtttcgctcttgttgtccaggctggagtttgcgcaatggcatgatcttggctcaccacaacctctgcctcccagattctagcgattctcctgcctcagcctcccaagtagctaggattacaggcatgtgccaccacgcccagctaatttcgtatttttagtagagacagggttttccccatgttggtcaggctggtctcaaactcctgacctcaggtgatccaaccacctgggcctcccaaagtgctgggattacaggtgtgtaccaccgcgcccggccccatctccctcttaaaacccaatggaaaagtagttcttctctaaactgagtaatttcctccactggactcacatgcctcttcattcatagctaggatatagctcctcccacactctgttggaattgactgtctccatggccaccttccctcttctcctggcttcaagggcagaggctgcatgtgctcatctctgcatgctgcctggcacatagtaggtggaggttattaccccacaaacacaggccatttgattgaaagggtacacttgtctatctaggaaatgagaacaacacattgaacttctctaacacctaactcctaggaaatccaaacccctcatttgcaacaccatcatcaaacatatgctgggtccttagcaatacggtgtcacagttgagcatttgagtgctggaactgtcgttatagttgtcatttggggaagaaagctcaaagttcacattttgtaaactttttggaaaatttcaaacatataaaagcagcaattataggatactgacaccccctgcccccatactccttccctgttacccggtttccacaatgattaatatttggttgattttttccttcattgccttccctttctcactatttttctggagtattttaaagtaaatcccagacataatattatttcatctgtaaatatttcataaacattctaagttaaaatcctagctctttgacatactatgtttatgaccttaggcaggttaattaatgtccctaatgttcatcttctacatatgtaacatgaggataattatggtacattcctcatagggttataatgaggagtgaagggactattccatggaaagcatttgacacttagcatgcactcagctggtgtgctaaggggtcggtgtcagccattaaaatcactgtcacttatcattactgaatttacagcacagcatcaaacccttgggacatgaaagacataagatctatcagtaatctgtatctatcagtaatcatgactgtggcagcaggatgggggcagattggagcacgaagaagctgggaccttcagagaacaaacaggaggctagaaaaagaatactgtagggagatgatgagacctcgaatgatgcagtgacagagtggagacaatacacacgtggagattagagccaagatctctgatcgactgcctgcagcagggagatgtccttctgcaattaaaggtcaagtctagattctggtggcctggagcgagtaagtcaagggaggtggaggcaatggcagacaatgagtttcttcttcctaggatcatgatctctggggtactgacagggcatcctatgctggggcatcctagaaaaaagaataggcaatgtgctaagagtttggatgtttgttccccaaacctcatgtggaaatttgatcccagtgttggaggtggggactaatgagaggtgtttgggtcataggagtggattccacatgaatagattaatgccctccctgcaggaatggagagtgaattctcattctagtagttcctgccagagctggttgctaaaaagagcctagtgcctcacctctctgtcttgcttcctctctcactgtgtgatctctgcacgtgccagctcccctgcaccttccgccatgagcagaaacagcctggggcttccaccagatgctcaatcttccagcctccacagtcatggaccaaataactcttttttctttaaaaattacccagcttcaggtattcttttataacaacacaaagggactaatacagcaggtgaggctgccgattatgacatggcaatgcttgtcctgccctttgtgaagcacgtggctcttcctagacagttggttgtcacttttattttggtgttacttacacagcttctaatgaaagattccagatgactgtacccttaagttttccctcagccatggctctgtagcctcgtttcactgctgtggtgatcaaagtgagctggtggttgcctcataatcacttttaataacttattatccaatgaacatgtgctcattgtgttcattttttaaaacacaaaaacattggccaggtgcagtggctcacgcctgtaatcccagcattttgggaggccaaggcaggtggatgccttgaggtcaggagttcaaaaccagcctggccaacatggggaaaccccatctctactaaaaatacaaaaattagccaggtgtggtggtgggtgcctgtaatcccagctactcaggaggctgacacagaaaaatcgcttaaacctgcaaggcagaggttgcagtgagctgagagcatgccactgcactccagcctgggcgacagagcaagattccatctaaacacacacacacacacacacacacacacacacacacacacacacacagttataatggagaaaatgaaaactagccctaaccctattactcagatatagccaaggttgtgaggttgatacaacctataatttgcattaatatatattttatatagataagcagaataagaaattgtatgttcagcgtgatcttatcatgttaatgagaaatgggaagcagtgatcttcagggatgttctgtgttgcccttaatcatcctaagcctgatggacattttgctccagttttttgcttttaaatattgaataacatatagtaactgttaaattagtgaatgttatacagctttattccatttctttaatttttctccttttaaaaggctgtttctactggcaaacataaggaaaggatccattgtttatccggcctttcctatacaaactgtttatcactggtaatcaaataatggatgaagggaaatgtctccttataaaattatggcagctaataaatgaacacgactgtattcatcctccggtaaattactggatctaggcattaagttagtatgctggaaagagagccagccagccattgtataggttttggagaaaagacacagcagcgcccgcggtcttggcaaagaaaatatattaacctgatcaaagcttccatccacctgaaggaaatacagagaatggaaagatacgttggctgcactggctgttcaaaatccgtaaagtccagacggtatgcaactccacaaagctcaacaatgggagctcttcagtacaacttgcagggaacagcagcaaagtggaagggtaatttgtagttttaaaatgactcaaggtccgggtgtagtggctcacgcctgtaatcccagcactttgagaggtggaggccggcagaccacttgaggtcaggagcttgggaccagcctgggcaatatggtgaaacctcgtctttgctaaaaatacaaaaagtagccaggtgtggtggcgggagcctgtaatcccagctactcgggaggctgaagcaggagaatcgcttgaacccaagaagtgggggttgcagtgagccgagattgcgccaccgcactccagccagggcaatggagtgagactctgtctcaaaaataaataaataaataggacttaaaagtatgagtgcgtgtatattcttttaattagcaaaacaaaactataatgcctgggatgcagagttgggtgaaattaaggaaatttaaggaagcgattactctaaaagtcaggactgagccagcgacatttgagggaggggaaggaggtgagattagcacaagggacacagaaaggacttcggggtggctgacaaagttctactttgatgtattggttttgtgtagttttctgtatctgtgttttacaacttttaaaagtttaaaattaaaaaaaaaaaaacacgaaaaaacaaactgaaagctgttactaggcaagattatttcaacagggcagagagattgaactcaattcctttgaaacaaaaggtagagaatttttgagcactagggggagatagtggcaaagtcctaaaggacgtttcaggaagaaggcaggtgagctgaagccatcaagccatctgtgtttgctaattggtgcttatggaagttaggctcttatccttcccagagactgggagatagggatgctatctttcttgattacattttgaagggatggttcccaagtccttgagaaagacattcctgggttgtagaagatttatgtcttaaaggagcaaaaataatttacaatatcaagttttctaaggtaaatgctctaagggaggattagggacctacagtcaggaagaaacctgttgatacagtttggatctgtgtcccaacccaaatttcatggtgaaatgtaatccccaacgttggagatggggcctagtgggaggtgttcggatcaggggagcaggtccctcatgaatggctcttgctcagagttcacaccagacctggtagtttaaaattgtggggcccctcctccctgtgaccccccaccaccacccctcgcctgcatctgcttttgccatgtgacatgcctgctccccctttgagacctccctagaagctgatcatatgccagcactatgcttcccataaagcctgcagagccatgagcccctggtgactcacacctgtaatcccagcaccttgggaggccgaagtgggcagatcccgaggtcaggagtttgagaccagcctggtcaccatggcaaaaccctgtatctattaaaaaatacaaaaattagccaggcgtggtggctcatgcctgtagtcccagctactcaggaggctgaggcaggagaatcgtttgacctgggaggcagaggttgcactgagccaagatggtaccactgcattctagcctggggaacagagtgagactccatttaaaaaaaaaaaaaaaaaaaagctgttactaacaatattgtgttggagagtgtccccctaaatccatgtttctccctgaacctcagaatgtgactttatttggaaacggggttgttgcagatatattgcaacaacattgcagatatttaaaacgaggtcatatcagattagggtggacccttaatccaacatggtgtacttgtaagaaggaaaaaagagagagagaatgccatatgatgatggaggcagagacaggagtgatgtgtctccaagccaagggccaccaaagatgccagcaacctccagaagctaggagaaaataatggaaaagattctttctcagaacctccagtaggaaccaatccggctgacatttggatttcagactaagcctcagaacttgtgagaaaacaaatttctgttgtttcaagccacctggtttgtggtacttagacagcaaccctaggaaactaatatactacccaaacattattatgtgttcctaattttaatgaaaagaatgattagtttagctcaagactgggtatgatttgttaaagcattatttctagtccttgtctgtatgcaaacaattgtttacttggttgaagttatagcccaatacagttttatttctggactttttttcatttgacagaacacctatttacatttctttttgtttggttttattttgtttttttgataaagggtctcactctgtcacccaggctggagcacagtggtgcaatcacagctcactgcggtctcgaactcctgggggctcagcctcccaaatagctaggattacaggtgcgtgccaccacatccaactgtcttttcattgcccaagctggtctggaactcctggactcaagcaatcctcccacctcgacctcccaaagtgttgagattatgggcatgagccatcttgcccagcctgatttgcatgtcttaatttgagcacgtgtatctctagtaggcattggttcacactagatcctgatgtttccttccttgaaaagaaacaagcccacctactgcatttccagcatgcaactttgcttctgagttttctgctcatgttgcactaagatctggctcattagaccatgaactgtgggttgctcttgtaacctgctaattctaacttctcacacacatcctgtgtgaccccaccaccactgagattcgtccctgaaaccatcagcagatgaaactcagctgctgggtcttttgagcggccacatggagacaatgaataggtataattaacagaaaaacaatatcctgaaggtttcttcatgcactgagcagaaatcaagttgtttgatacttgcgcagaaccaaagctgagatccgatttcttgtctgttgccctggagtgaaaagggttgtagtcacggctatctgctgctttccagcatgccaggatatttaagtcaagtgttaaactaggctctatccagatagcaaaaagtggaatgtcaggccgggcgcggtggctcacgcctgtaatcccagcactttaggaagcccagacaggcggatcacaagatcaggagttcgagaccagcctgaccaacatggtgaaacccggtctctactaaaactataaaaattagccgggtgtggtagcgcatgcctgtaatcccagctactcaagaggctgaggcaggagaatcgcttgaacccgggaggcagaggttgcaatgagccaagatcgtgccactgtagtccagcctgggcgacagagcgagtctgtctcaaaaaaataaataataaataaatggaacatcatctccccctctcaggggcatcttagccaagcaggggacctgtctttcttgttctttgcatgagtcacccaagcacgatgccttctcacagtaggcagtcaatatttgttaaataaagcacttttgaattaaaaggttctaaaacgtcagagttccagaatcaccaggagtagactacctgtccagtctcaataaaagaggcctagggtgaggccaatacatcactttttaaaagcaacatatgcgattttttactttttttaaagatcaactccaaatataggaaacacacgtgattttaatgcaggcagtctttaatttctatttttaagaaaagctaatgtaaccacttgagtgttttgaaatcagagaccatattgtgttctgttcatgagcgcctattgagctgtgtaccacacactcttcctcgttcttgggaaagagcagaacaaaatcccctgtgtgcaacatgttatgtggatactgagatggggcaggtgcatgctcttcaagagcccatggagcaatgggaggggagagatatagaaaaagtttttataacactgtgattctcaactggaggtgcttttgcctccctaagggacatttggcaatgcctggaagcatttttgtttgtcacaacggggtagcgctactgacatctagtgagcagaggccaaggatgctgacgaacatcctgcagtgcccaggacagcccccacaacaaagagttatctgggccaaaatgccaatagctactagattgaggaactcttcaacagagaatggggccgggcgtggtggctcacacctgtaatcccagcactttgggacgccaaggcgggaagattgcttgaggtcaggtgttcgagaccaccctggccaatgtgatgaagccctgtctccactaaaaatacaaaaattagccaggggtgatggcactcgtctgtaaccccagctacttgggaggctgaagtgggagaatctcttgaacctgggaagtggaggttgcagtgagctgagatcgcaacactacactccggcctgggtgacagaggctccatatccccccccccaaaaaaaaaaaaagagagagaatggaatgagtgaaatgacccagggacaagcaagatgcatatagaagtacaaaggaaataaaccattcctggtcctgcaatacaatacccagcgtcctacatccttccttccttcttcgctctccattgcttccaacccactgtctcatacctggcaacagtgcatcaagcctgtggttgtatgaagcggggtctaaagcctagtttctctgtatccactgtttaaccttaagcaaaaacaatgggtaagacctgtttgatagcacagtggggtgactatagtcaacagtaatttaattgtatattttaaaataactaaaagagtataattggattgtttgcaacacaaagagataatgcctgaggggatggatactgcattctccatgatgtgattactatctattgcatgcctgtatcaaaacatctcatgtaccccataaatatacatacttaccatgtacccacaaagattaaaaattttaaaaatttttaattaaaaagaaaaaataaccttggacaagccactaaccttcctgaacctcattctcatctcgactctcctccttgaacaacagagactcaggaagaaaagggggcctatttttatgtacccctgattgacagcctgacaaactcccacttacctcattgggttgatgcaatgaaatgaggtcatgcacatgaggtgctttgctcggtgacagcacctggtaagcacttgtcatatgtcagctgccgcaatgatcatgagcaacggcctccaccaccccatagatttaccacctctgccttgtcctttacatttacccaatttggggttcatctctttccttgagacttatcttctcccattacaacctatgggcatctggtgactctcatattattacattcttaggttcagagcctatagtttgctcctcctatccttcctcgtgggaggatccaatatataccccgctttagacaaagtgggggagaaccggcttttgataagaacactttggttggcaatgctttcgcaaatagaatcgctcttttatttccactctatactttagtctgttccccagactctttatcccaggcttgggctctgtctctgttggctgactaattttgcagcctaggaaccctagcatttgtgtagacaacagttatatatggattatagagtcaacgtatctcagtttccttaggtactaaaaataccacctattcctgcaaaccagccctttttctccaagcctaagaaatgatcacctctgacttctattaaagtaattgtggattttgccattgaaaataagggaaaaaatcacaattcctttgtaccaacttaataaatggtactttcccaaatgctattaggtctggctgtcatccctttcaaagatagctccccacttgagaactttcaaggttttgaagggtctttggaattcttaaatttttagcccttttccatgaattctcatgtttgacaattccgggtgaaaaccttcagacattatggaatgacatagctaccaatctatgagtaaataaaaccagtgttacctggaagcaaggcaattacatcattagtaaataactagagtcctccatgcagaaatataatatctttctccctgagttgagggttttgttgaaagattcaaagccaaaaaaaagtttaaaatctattttttagcaaggtgcagtggctcacgcctataatcccagcactttgggcagccaaggcgggtagatcacaaggtcaagagatcgagaccatccaggccaacatggtgaaaccccgtctctactaaaaatacaaaacttagctgggtgtggtggcacgtgcctgtaatcccagctactcgggaggctgaggcaggagaatcacttgaacccgggaggcggaggttgcagtgagctgagatcgggccactgcagtccagcctggcgacagaacgagactctgtctcaaaaaaataaaataaataaaacaattatatataattataattatattaatataaaatttataataataataattataaaataattatagttctaccattctcgtgtggaattgcaggagtggtgggagctcaggttgttactttaacccctcattctcttactagagcaatatttccttgggttattaatgcatttatttttgagacaggggcttgctctgtcacccagcctggagtacaatggtgtgctctcagctcactgcaatctctgcccaccagattcaagtgattctccttcttctgccttccaagtagctgggactacaggcatgtgctaccagtcctggttaatttttttattttttgtagagatgagcatttgccatgtgggccaggctggcctcaaactcctgggcagaagtcatcaacctgcccagcctccctaagtgctgggattacaggcatgaaccaccatgcctggccttcttgggttatttatatgtccctccgtttggctgagtgaccaacttctactcaagttacttcctctcaacagcttcctctggttttcatccttctcccatatcaaataaattgcttcctcttctgtgcccatcacacctcaagcatctctcttacacactgcgcaacagatattttcccgcaggtctttccaagggactgagcatctccataagctaaagtacctcacatgtcttttatcctcttccccaggtctcactcccatgtaggaatcagcatcccctgagtgtccacttcagttctattcaaccacccaaatccagcactgtggagcgttgttaactaacacaaacactggagggaattcaccagatttttttttccctctgctttagttcaaaacacaataagacaagaatatataatttggtttcattatgagttcgatttctgtagaacattctggctcttggttcaatgtttaattcatatgaaccccttacgaccatgatgtatatttgatcaggagaacaactaccatccaaggacgcaggacaaaaggaacagttgctccatccagattacactgccttgctttttgctttctcttcttctccttcgaagaacattctgtctcttgtaagccagtgttcctactaatagcccctttaaaaatcctcttgaagaatcccactagttatcctgttgccaagtaggtacttcctttataatagctggttgaatgtttctcccattcctttaaaaatagtaaccattcttgcaggaccaagactatgattagtcaagacagacagctagggtataaaatgtaaggcagcgctcactttcaggtgctgatcctgcacttgtgtgactcagagaatggccacctccttaaattttgcacgccagtcacctcctctgccccaccctcatctattccccacattattgcaaagacccaacatgcagctgctctaaaaaggagctgagtgtttgaatcctttctctacccttccagtcgattaattcatggttcctgacattctacttttccagtcactcttccatctgggtcagaatcttggggctcacgcactttagactccagaagaagctacttggcaaaagccagaaattccagatctcaagcctacttgcaatgaacatgttacatttaaatacccactttatgttttagataatcatcaatccctcccaaagatggatattgttaatatgaggaatatctcacagatgactttggtagatgtgtttcttaattaaagtattactcatttcttctttttcaaagcttttaatttatcatctaacaggcgtagtgatccatggaattacccccctcttgatttttccccctttttacacggatatgcttattatcattcatagcataagccaagtgctatggttattaagtgctgtcatttgtaccctaatgactttgtgcctttcacaccattaaaaaggaagttggctactatgaagcactaaatgaagccccaaacaaagactgaggattattaaccctcgtggcccaagtgtgaaggaactaaccactcacgtaggtgaggggagataggaggttctagatttgcaaccacattcatggaaactctttggaatgtagtaaccaaagtccccaactactttccagaattttgtcccaccttgacttttgctcttttgtccccaaggccattggcttttttcagtctctcctgtcacattccacttcctctgcttggaatggtcttctctctctcctcttgccatagctaaatcccatccatcctctaaatcctagctcaattatcacttcttcagagaagcactccctgatcttcccaaccaggtcaaatccccatccacaacctcataacaccatcttaccaagtggtaatgttacatttgtttgagtcattcttggataaagcccatggctccatgagactgtaaaagcctcaccagcttagggggtcttgtagggggttggcttgcttgccactgtcttcccagggcttaacagttagtacacactcagtgtatttgttgaatgaaaaagcttggagccaaatatatcagtcagtaccctggcaggaagcaagcagcacacttagctggggttctaaaggtatcagagttaaggaaaccaactcaacagggatgttgagatgcccagaaactagccacagtaggaagatattacccaccctgggcctgaaggggcacgaggaagcaaaggcattaacagattgcacagagaaagctaggaccttgcaggagctgtagttgtgaagaggcatagctacttccagagacccatcacaaggcaggaatgaaaggggaaatatcttcattctcctttctcctgttttctgatctagcaggatctcattggccaaagccaactggaagccatgggacaaggagcccagtagatatagtccatgggggaatgaatagaggccagagaatggaagagtggaggaaccccctattgataaccaagaccccaaggttgcagcccaggacccctcctcagccctgattgaggcttccagccaccccacctctcctaatttcattgcagacagtaatgactataactactgccgagaaatgaccgtgactactgctcctctgcttgcatggggtgagccaattaaattttccccatgggtcacgcgctgagtcttgaacaccagccaacttcattgagagcatgaactgatggcatgagttcagctccaatgggttgcaatccactggggttaaataaacaaatcaggaactctgcattaatgagtctagctacacagagtgaaatatttttgaataaatttttctgagagcatctatcaggacgctgcagctcctgtgctgctgtctgtctttaaccttgagggaaacagctggggcagttttcaaaaaggatgggcttgaggaacaagagtctttgttggctgcacgtctattcacagagaagcaaaaaatttggagacaggagttccaggctgtcaccaagggggcttctccttggtgcacggtgatctagctcctgcccactccgctttgctaagtcaaccctctctaaatcaccatgaaccgggttcaagggcttccttccagtctttctccttcctccctcggatctgttcaccttcttgttcccttaccttgccctactcctggctctcagatccctgggcctgttccaatctctgatctacattttagagatggaggtgggagaagaaaccattgttctccaaggtttccatggccctcttcttatcgaggactggatcagtctgtgactcacaacagccaggtagcaccacggttcttcatttgacttaggatgatcccagattggcctcctcaacctcattctttctcttaagccccatacccaggaatttcctgccattttcccctggctgcccagccaggatctcaaacacaacactagacatgaatgcagcctcttctccttggagaggaaaccaggtctaatggaaaagcctgggcttggccccctgccttctgaccttactcccagctcctccactatcagctgtgtgatcttaggtgaaacacttagcatctcggaacctaaggtttgttgttccaaaatgaagctcagcaaagatgatgggaatgctatacagatgtgaatattgttgtcatcatttttgtcattatcatcattgcattgtgacaaatccctcactgggaaccccattctgactagtgtgtctagagtatcatagtcctcctggtcagctgtgagtcatctctaattctttctctcctcagtctctatgtcatacccacatcctaatttccagaacctgccagtcatgccacgtaatcactgtgtcctgtagccagacccacccctcacatctgcagggccctgggcaagagtgcaaatggaggatcccagcccgtggtcagtccccttctgtctccaccccagagtcccacccacaccaccaggaggggtcctgcccatgtagtgggaaaaagtcctcatgtggtcttggggccatttgggaatagaattctggaaggccaggaacccaaagcatggtctagaagtgtatgtgttgggggagactttgctttgcatggctgtccctttggcttcaaccaaagggagccataggtaggggtgctgacataggtagggatgcaagcagaggaaggccagggtaggcccctctaagtggggcccaggtctcagagtagaatctctcctctggacttgggagtcaaacagaacccagttggagtcccccttttattaggtggcctcgagtatatcataggcgggaccatcctataatcctataaggaaagaaataggccgggagcagtggctcatgcctgtaatcccagcacatcaggaggccaaggcaggaggacggcttcaatccaggagttcaagaccagcctgcacaacatagcaagaccttttctctacaaaagaaggaaagaaggaaagaaggaaggaaggaaggaaggaaggaaggaaggaaggaaagaaagagaaaagaaaaaatagctaggcatggtggctcatgcctgcagtctcagctacttgggaggctgagacaggaggattgcttaagcctgggaggtagaggctgcagtgggttgtgatcatgccactgcactccagccgggacaatagatagtgatcctgcctcaaaaacaaaacaagaaaagaaacaatcttagggttctgggtgaggaggacatagacagctttcagaaatcgagtagagggcgctggatcctcaagttttctcctaaagaggcttctagtggatccagtaactgtgtcagatgcttaacagacatctgccctcaaccttcacggcagttctattaggtgggtgagaacctgggccgagcagaataataccacgcaaacgtgcccacatcctcatccccagaacctgtgaatctggtacctcacatggaaaaacggactttgccgatgagattaagttagggacttggggatggggagatcctcctgggtttttcaaagagggaggcaggaggagggtgagagtcagagagatttgaagctctaccctgctggctttgaagacggtgggagggacctgcaagcaaagaaatgcaagggcttcttctaaagacgggaaagtcaaggaaacaaattcctccctggaaacaaatgcaggaaggaatgcagccctgccggagccttgatgttaaccctgtaaaacccatttcaaacttttgacctccagaacggtaagataataaatttgtgcttcaagtcactgttggtggtcatctgttacagtaataataggaaactgatacaaaaccttaccttcacttcgtagaaaataaaggggggaaaaacccacagtgtcaccgagaggctgggggaactgcctgaagtcacacagtcagagaatgcaggagcctggatccctcctgagactcccgtggctccacagtacaggctgggtcctcacaggaaaggcatatgcatttggtaaacaggggaatattggggaagccatgggaaagtgattttcacttctctgtgatacttcccagcacagaaatgatttgaagcaatcagagacgagctgtctcactagcaaagaggacgtcttcgcaatacgtgaagaccttcagaacaaaaccgaaagtcttacaaaagggccttccgtggtgcaaatagtggctggttagggacttcaagatctgccacactctccacttccagaccccaggatctggccgctgccttcccctccacctgcccttgtatttttctccaccactctggcctcctcttagagaatcccacgtgggattcagatccacctggagccaaagcatatgttccccctctccctgaatccctattgctcagctctttctgtggctcactccttcctgctcttcaggtctcacccatcacctccttaaacccacctacattagtgtcctgtaagctgctgttcaaatgaccacaaatgtagtggcttaaataacataaaagtattatcttacagttctgaaagcccaaaaatcaaggtgtcagcagggctgcgttcctcgtggaagccctaagggagaatttatttccttcccttctttagcttccagaggccacgtgcgtttttcttgcttcacggtccccccagcaagggcatcactccaaactctgcttcccttgtcccatcacctgctctctgagccaaaccttcctgccttcctcttgcaagaatcgttgtggttccatggggcccccagataatgcaggataatcccccatctcagatttttagcttaatcacttctacaaagtccctttgccatgtcaggtaacaaacatatcctcaggttctggagattagggaatggatgggttgggagtgtgaggtcattctgtctgctttccccagggatcttgtttaactgggtcactctcccccaacccctcaccatctattctccatcgtggaacactgctcacgccctttgtagcacttttttttttttttttttttttttttttttttagatggagtttcgcccttgttgcccaggctggagtgcaatgacgtaatctcagctcaccgcaacttccgcctccccggttcaagcaattctgcctcagcctcccgagtagctgggattacaggcatgcaccaccatgcccggctaattttgtatttttagtagagacagggtttctccatgttggtcaggctagccttgaactcccgacctcaggtgattcgcccgcctgggcctcccaaagtgctgggattacaggcatgagccaccccggctgcctgtagcacatttttttttatgattatgataagcctatttaataagggaaactgtgattcccccaggacagagagagaacatctgtttcagccagctcccggcccagggctttggttctgttgaatgactgaacaaataaataaatgaatgaatgaatgagtgaacgaatgagtagtatagatattatcactcacataagatgagatgcagagagaggaagccagttgttagaatgatattaccaactcaaagcagaaccaggtttcagccctggaatgttcccactgcctcctgccaccatgcacttgggatgctgtcaaattggcctcccagacaccagaagtgtcagagaaagtccagatgtcctttgagcttagaatgttggcatcttgaggtgcttgaatgacatgactcagatttcctccctccactgtctggatgggaaaccagctctgttggagatggcctgagtaaatccagaatcccagccctggaaaatccagctgccaagaccagatatggccagccacgcagctggccgtggcatcccagactgggtgtgggaccatggtcctgattatgaacagactccgctgggccacccaggctgcacttagcaggccaccaagagatagctgcccaggccaggggctctaggatgtggggtaggcaggacaaagacctctaggtgaggctcagccacatgacatctcactgtctccacatatccactttttcattcattcattcatcccagaagctattgtgtgacagatgtccttttgcactatggactctgaggtagacaccattgtcctgcccatatagagctgcaatccccaatatggtagctatgagctatgggaggccaatgaggacttcaagtgtggctcatctgaattgagatttactctcagtgtaaaatacaccctagattccaaacagtcccccccaaaaaagcgtaaattattacttcattatattgagtatatattgaaataacatgttggatatatttggttaaagaaaatatctcaaaattaatttcaccagtttctttttacatttcttgacgtggttaatttgaaaatttttagccacatttgtggttcgctttatatttattttagatggcactgttctattgatttgcaatggagaggagaggctgatgtgtaacttacaaggctggggtaaggttgacatcactagccaactgaggtgtgaaggggtaagtgcttgggcgagactgtgaggttgagggtggagggcaaatacttagaagagctcacatccaagtcaacaacagcaagacaaatccaaggtagctcaggaccagggcactccaggaggggacccaggacgtacagagacacagtgcagagagcccagtgaacttcagatacatcgtaagtggtggacgtgagtgtgtgatgaaaggtgaagaaaagcaataaagccagaaaaggcaacagttaccagctccagaaacatgcagtccagtgctgttcagcagaattatgtgagccacatgcaaagttttaaattttctagtttctagccatattttcaaaactacaaaaaactaattttaataattgttatttcaacatgtaataaatgtcaacaactcttactgaaatagtttggattcttttttatggtgattaagtctgtgaagtctggtgtgaattttacactgacagcacgtggcaatttttactagccaaatttcaaaggcgcacttgccacattgactagtggctataggattaggcaatgcaggtctactagacagttctcttgaatacagtggggaagggttttaagcagtagagtactttaaaaaaaaaaaaaaaaaaaaaaaaaaagcacctctggtggtcccaacggagaagacaagtctcccacgtgctactgagctttctggagcccatcgagcccatcaccactatcttctgggcactgtcacccccgccggggtgctttcacttataaacggtaatttgggagcaatgtctcttttgtgcagactttgctttgccaaggtgttatatgagagcagtttggggtgttgacaacagaggaaggggaagctgccctctcagatcccccatggttctcaccacctttcagatgggcaccagaggcaagaaccttggatgttttatctgtgaaactgtggtgcttaactcagctaatcattgtgatgcttaactctgcttatcatcaggtttctcctctgtgaaactgatgcagacacttctaagaggcttggtgtgtgtggataaaaggaagcaacttatgcaaagggcctcatatggtggcctaagaaagaattaatcaagaacaatatcatttctttccttcaacattgtcatcagaaaggctccaagagcagcctaacaagaggatagaaatgcacacagcgtgaataggaggtcaggctacttaaatggcctcttggaaatactgctaatcctttatccatcctttccgtaagggacttcaaggagtcagttcatttcagaaagaaatatccaaaaagcatgcagattagaggcagccctgcagggagctttttctcctagcatcacaataagctttaactggtgagaaaacagcttttcagtttctctgggctctgtcttactggagaggcagcttaaaagttgttcctagtctccaaggagttttcagatgctaataacttgccagggtgataaataactgaatgctggagatctatgacgtgagacactacctacctcattcctctgcctttgagagtcaaacaaagcagtacggactaggcagaactgggaaagagctttagttttgaagtctggcagccctgagtgccaaccacaattgtgtcacaattaactacgtaatctttgggtaaattgcttctatttttgagcatcagggtacattatctgtaaaatggggatatattttgcaaggtaataattatgtatgtgagataagaatatattatctattattgcatttaactcccccacccccaacaaacttagaggcacttatgatctcccagtttctgtgagtggggaatctgggcacagcttagttggtcctttgattctcacaaggctgcaattggggtgttacaggaaaggggtcctgatccagaccccaagacagggctcttgggtctcacacaagagagaattcagggccagtccacagtgcaaagcaaaaacaagttcaagaaagtcaagtggtgaaacaatagctatgccgtagacagagtagtgagttcctgaaagaggaggaacacgttcaccctgggtacaatgcttgtttaaatgaagaataaaaaaagagcatgggctgggcgcggtggctcacgcctgtaatcccagcactttgggaggccaaggcaggcggatcacaaagtcaggagatcaagaccatcctagctaacaaggtgaaaccccatctctgctaaaaatacaaaaaattagccgggcgtggtggcaggcgcctgtagtcccagctactcaggaagttgaggctggagaatggcatgaacttgggaggcggagcttgcagtgagccaagatcacgccactgcactccagcgtgggcaacagagactccatctcaaacaaacaaacaaacaaacaaaaagagcatggggacaggctctgctacgagggtttgtgataaaggattaatttttttaattactgtattttgcaagaatcaattcttttttttttaaagacagtctcgctctgttgcccaggcgggagcacagtggcgcgatttcagctcagtgcaacctccacctcccgggttcaagcaattctcctgcctcagcctcccaagcagctgggattacaggcacccaccaccacacccaactaatttttgtttttttagtagagatggggtttccccatgttggccaggctggtcttgaactcctaacctcaagtgatcttcccgccctggcctcccaaagtgctgggattacaagcgtgagccactatgcctggcctgatattattatctttaaagcaaaattaggaatgcttctgttctcaagatatcgagatattgttatcagcacactcccaagtctgggtctgtttagtaaacattatcaatctgttcccttaaccgtgagtatctagaggctaggaatacctaactctctggggatgcagcccagcaagtcccagcctcattttcctagccctcactcaggacagagttgctctggttcaaatgcctctgacaaaggtgtcagctggggctgtggtctcaaatggggaagggtctgcttccaaggtctctgtggtcgttggcaggattcagttcctcactggcatttggaccgagggtatctgctcctcattgactgtcggctggggtctgccttcagtttcttgccatgtggacctctccatagggcagctcacaacatggcagtttgagtcatcagaacaaggaagcatcaagagttagagaaagagggactgcaagatggaagtcacggtcctttattacctaattttggaagtgatgtatcatcacttttgctctattctgttgcttagaagcaagtcactaggtgtagcccatgttcacggggaggggatgagtaccaggcaatggggatgactgacaaccattttagaaggtgtctgctacaatatatgaagattcccggtgggcagtagctataatgaacaaatgtgaaaacctttgaaaagcagagctcactacaaaaataaaaggaatctactgaattatgtattagggtcaagaaattttaacaatcatatgacactattaatcagagatcagggccgggcacagtggctcatgcctgtcatctcagcacttaggggaggccaacgggggaggatcacttgaggccaacagttcatgagcagcctgggcaacatggcaaaaccacatctctactaaaaaaaaaaaaaaaaaaaaaaaaggcaaaaaattagctgagcacgtggtgacgcttgccagtaatcctagctacttggtaggctgacgtgggagcattgcttgagaccaggaggtcaaacctgcagtgatctgtgattgtactgctttactccagccaaggcaacagagcaagaccctgtccccccaaaaatgtgttgattccgatcactgccaggttgtccaaagactgcatttaaaagtgcatttatattaaatactgatttgataatatgttaccagactgacgctaaagttaaaaggcatccatttcttctacatgatgttttatcatatatccatagccctttctagttattttagtatatgtgtgtttttatggagctagagattaaaacattttaaatatgcatgtcagttctcatttagcaatattacaacatttaattctgctatgtagtctttgtaattagctgtatatatctttatcttctttaacaaccacatatcatttcctttcagtagacacatgtgagagtcattatttacttaatcatccccttatctctgggacatataagttgcttcaatgttctgccataaaaagcaatactgtaattgagtatcttttgtgtaataagtttttttccccataatttaaattatgtctttaggataaagttccagaaaagcaattagaatacaaacattttaatagctgtgtcaagttgttatccaaatgtgtagaagtcttcggttttcatacaagcaaatactgctctatcaatcagccacagggtgagttcctcaaaggcaggcactgtatcttactttttaattttgtttaaccatagcatctaggctagacgcaacatttaatgaatatttttggactgaattaacacaaattttaaacatttgagacttcaggaaaaatatttaggctagatctattaaaacttttttttttttcttaatcaagagatgttgcatttccacgcagatttcattgagatgtggagcatgggcctgtaccaagcaccaagctccatgttgccctttctggatttcatttaactctcatgcctccctccccatccccacctcaacagttggaattccacatggcaacagaatgaaatgctcaaaaggcaaattggattctgccacaaacttaccgtttcagaggatcccaggagacacctgttggcctggcaagcccccaacatttgaaaagaaacaggaggccctctttcctggggagaatattatagtgttgaggggaaactgcacttagatagagacaacatttcctcccaataaccagaatcgtgagaattttcctgagttcagttcagccttgagtaatgggtcaatttagcccaactacgagtcacagttaaataacattgaagtaagcagggcacaaatgaccttcagaaaatatctctattggtcaaaatctaatctgactaatgcaccctgccaccctgcagcacataattctgagaactccagagaaccttcccccacccttttaaggaatgttcatctacttatttcaagagctgtcaccctcacttttccgacccagaagatgtttgcacaagatcagtgtgtgtgaatggcccaaccagaatgtagttgcaccccagcgtccaacagcaacctcttagccactaaacttgagccgcagcgccctctggtggtcacttgacagtttgagttctccaggccccctttttaactggggaacatctcgcctaaccagcacctctgtttctcaccttttcgcgcaggtgaaggaggccatgcagcggattcacgaccgagggaacattggcaagttaattctggatgtagaaaagaccccaactccactggtgagtgaaaagcagaggagtctgttcagttccacgcgagagagcaccacgggtcaatcagatgcagacacgggtggggtagaaggaagtacaggtagcctgtgggctagtggaggagaccaggggtaatcaaatgatgtcatacatgagggattcatgacaaactgagatgaatgctgaaaaggaaaggccagtgcttcagtgagagcatatcaaaagcaatctgaaggcataggcaggaaagcatagcaacaacagacctgtctattacagctgctagctcttgggagaaattcctggaaaatttcaataatttcacattcatgttcctaacagaatgatgccagctgcttccgagatgctccctgatggttccacagattttttttttctttctttcagagagagagtcttaaactctgtcacccaggctggagtgcagtagcactatctcaactcactgcagcccccgcctcctgactgaagtgatcctcccacctcagcctcttgagcagctgagactacaggagaccaccaccacacccagctaattataattattattggccaggggaggtggctaacgcctgtaatcccagcacttggggaggctgaggcgggtggatcatctgaggtcaggagtttgagaccagcctggccaagatggtgaaaccccgtctctactaaaaatacaaaaattagccgggtgtggtgtcaggtgcctgtaatcccagctactggggaggctgaggcaggagaatcgcttgaacctgggaggcagagattgcagtaagccgtgattgcgtcattgcactccagcctgggggactagaatgagactgtctcaaaaatgataataataataatataaaataataaaaataatgtaaaatataaataaaaatataatttaaaatattatttatattatttttagagacagaatctcaccatgttgcctaggctggtcttgagctcctgagctcaagcaatctgcctacctcggcctcccagagtgctgggattataggcgtgagctaccacacccagctgtgattttttttttctttcaccagaataaaacccttatatcccagggataccaccaggagtatagcatgtcaaactcacatcccacctattctccctggggcctctcgaggaggaactatgtagtggtgtggtcagtgcacagaccatccgactgcatggattcaaaaccttgagcccctgtttatgacctgggcaagttacatgactactcagctttgatcccctatcggtaaagtggagattgataagttcccagttagaatagtattcataaagcattgtctgatatgtactaagttccaggtcatctttttttgagatggagtctcactttatcacccaggctggagtgcaatggcacgatctaggctcactgcaacctccgcctcccgggttcaagcgattctcctgcctcagcctcctgagtagctggcattacaggggcccaccaccacacctggttaatttttgtatttttagtagagatggggttttaccatgtgggtcaggctggtcttgaactcctgacctcatgatacgcccgcctcagcctcccaaagtgttgggattacaggcgtgagccaccatgcctggcccccaggttatctttaacagaaaaaatattcgggaagtgtttcttgtttcttcatttacatacacattgattcttgaagctgcatcagttctttaaaaaaaaaaaaaagaactaaaatttcttgcatattgtcatgtaaagtgtttttttgtttgtttgtttgagatggggtctcgctctgtcgcccaggctggagtgcagtggtgcgatcttggctcactgcaagctccacctcccaggttaatgccactctaccgcctcagcctcccaggtggctgggactacaggcacctgccaccatgcctggctaatttttttgtatttttagtacagactgggtttcaccatgttagccaggatctcctgaccttgtgatccgcccacctcggcctcccaaaatgctgggattacaggcatgagccaccgcacccggccaggagtgtgtatttttaaaagtatttccttgacttgtaaccataatgtaatttgggtatgacagtcatttcattcaatgaaggacaccttcaacattgtaaaacaccctcttgttaagtgactgatacaacatggatataacttattaaatacttactaagttccagggctgttcaaagcagatgagagggcaacgagagggaggggagggagtgacttggatcctgagtctcctgtacacctctttgtagtctttaaacatatgaccaagtctctttcagtcccatttggagaaggcagacaggctctaggcccatcctggaagcttatggctttcaagaaaatagttggcaccaatttcccaccctgggatgctcctgtgtccatcacacatgagttgctcccaagtcctcgggctgataggaaggcctgtcttaccaagggaggattcttactggagcagatgctgaaaaatccacctttcagggtaaaggcacaggatctgcctgtgccacacacaatgtcattgtccttgtttctgaacctcctgaagccttcttttttgaaatgcagtctcactctgtcacccaggcttgagggcaatggcacaatctcggctcattgcaacctctgcctcctgggttcaagcgatcctcccacctcagtctcctgagtagctggaattacaggcacatgccaccacacccagctaattttttttttattatttttagtagagacagggtttcaccatgttggccaggctggttttgaactcctgaccccaagtgacccacctgccttggcctcccaaagagctgggattatagacatgagacactgtaccgggcccccttgaaggcttttatccctgggacctaaagaaacaaaaagacagtagagaatgggtaatcagagcaaccacgtggtggaaaagaggctacggcctatctagatggaaaagcagacttgaaggaaagggagcatgtcttgaggttaaacagaagacatggagatgcaggagggatccagtgaggtcattttagggttagcacctgacagaagaggaaacaactcaagctccaggctccacaggatgtgtcgctgtccgctcagcaggtgctggaggaggggacagaggcgcctgcagaggtgctttctcctactggaatgaccacttttttttttttttttttttttttttttttttttaaagacagtctcattctgtcacccaggctggagtgcagtggtgtgatctcagctcactgcaaccttcgccttccgggttcaagtaattctcatgccacagcctctagaatagctgggattagaggtgctcaccacaccacacctggctaatttttgtatttttagtagagatggggtttcaccatgttggccaggttgttcttgaaatcctgacctcaggtgatctgcccgccttggcctcccaatgtgctgggattacaggcgtgagccaccgcgcccggccatgaccagtctcagccctcactcagccccgaatctgcccagccagcatgctgcaggacacacactgctcctctagaatagtctgggctctaaggcgtgtgggcagcacccaggcaggggaagtcgactgctactggcagctccagaagtaaatttcctgggaaacactaagagtggagtctctcctgctgaaagcctcctcttaatgaggctggaccaaagcaaagtcgaaactcatcctatgatgtgtcatgaggtcagagcagaggcagaactgctgcctccagaccccacagtaccagcgggcagccctgccccagtcctggccatctgaccagtgccccagagaatagaggtggcctttcctgaaggctactgacctctgctgcccttatggattctgtgttcacatcacctcagggtctccctttccactgctgtagaacagaactaacaacaataattactactattgctgctacttcaaagagccatagagaagattaaaagaaccaatgtctgcgagccaattggcatattggtgactatgtattataatatacactactaaggaacagcttagctggttagttcttcattatcctaaaacacttgttgcatatgtacctagtggtagggaagaaaactgcagagacatggtcctctcccgtggtgtctaccgtttggcaggggcagatggacattggccaatgagccattcatataaatgggacattgcagctcttgatcagtgctacaaagaagaggtatttgggccatgaaagctcataatagggagattgttccagttagggaattctgcaaaggcttccttgaggaagcaggatgagccctaaaggaaacataggtatggactggatgaactgggcagagggggtagaggaatgacattccagggagaaggcactgcacatggtgtggccaagggggagaacccagcttcaggtgagacaacatggggagagctgagattcaggggccaaattcctgtttgtcagaataagccatgaagcagccaaggactcaagtgtgggagatctggggcccaatctagatcaggggataagaacagaaaagaaatctgaggcacagatcatgtaggggatgttaatggacagaactagtttgttctgagtctctgtcatatgctcagccctttgctagactctttagatacattactccattttctttcacctggttcttaaaacaaatttataaggtaggtggatttatcgccactgtaatgatggcggaaatgaagacccagaggggtaatcataactatgccaggtaccagtgattaacaaaagaaaaggagtcaggcaaaatccctgtcttcccagaaactatattccagttgggggaagagagaccaaaaagcagatcaatacacctttgttctggttgttgtgtctgctcttcttaagtgacagcatcaagacttcaaccctggggactctgtgcagctgatgctctcaatacccctcacacctccccttggcattcgggtcccctgcgctccaggggcacctcttgtgggcacctgcccctctctgcctgagagctaactcttgtcaccagagcatgcttgagttttgcacagaaactgcgtggggtgcagggagataactcacctcccctgagagcagcccttagccataacatggcttcctcctccctcagaagagacagctctaagatgtgtcccccagggtctctcagaggtccccagcaggactgagtcccactgcccacacaggaaccaacttactaacataccctgcattggattcttcccctttttggtctcatttcttcactcccctgctactgcttcctgggatcatctcctaaattccagatactggtattcaaatccttatctcagcaccgtctctcagggtgcccaacatatgacagctaatcctgcattgccttccagggaaacaagcaaccctagttcctagcccccaagaagtcctcccataggactctgtcagatgctcagagatgacgaggctgggttgcacaaccctcaataacatcctcttttgaattacagatggccaatgacagcacagagaccagtgaagcaggggaagaggaggaggaccacgagggagacagcgagaacaaggagcggatgccctttatccagtaactgaggacccaggtgggagaatgtgaaggatggtttggaagatgaggacccggctgagaaaactcttctgtgccccagtgaacaaatgctgtagtccagtgcgtgtcgtgtttgtctgcagtcagctgagctaaaaagctgttgatcactgttgttttttgaagtgccaatcccatgccatgcagtattatgtccctctcctatctgtgtattacacattcccctctcccctgtatcaaaaccatccatctgtgggttcttcttgacagttctagaacagccttgcaaattaatacaagtcccaggcccaatgcctaagagaccagacgtgggcaaagacaagtttggatggaaaggtgttatcacagagccctgtccagctcctagaattcctcaggccagtgacacttttttgctgctggccacccatgcctctgatgagaacacttgccaatttggccagcagaaagagagtaggccggatgttttcatgagcccacaaatttagaaactctcctagtagtactttttctctctccatttaagagacaactacggtcaaaagtttgagccattctcttctaccccttcagtgtctgaccctttcactggctcttatctgtaaacacagggaggcaggtatggatttttcacagtagacaatgggtcaacagcatgagtttgaggacctgctgtgaagatttctcctccaaaatacatctcatgggcaggattcttcctgctccatatctgtttcaattttaagaaagcaccacatacaagacacattcagaagtcattcctgagcattgctggtgtttgcacacttgccacctgcattaccaattctgtaaatttcaattcctggtggaaagtgaccactttgaccatggatttcccaaagaagagttcctttgcagaccataggtggaaaagtcaatgagcatctccttccttgccaaagcatgtcccaacatgtaacaaactctagggatacaaaaggtttatattcagcatctgatgtcagatgtacagttcctcccctcccatatataaaccccggtgtagaatctgcagcgccctgctcttcggaaaccaaggaacaagccacctgctcacacaccttgttcaacttttcagctcctaaggaaccccacccccatgcaatttgactgtgcttgagaggtgaatacagttaccttcgagaaacagagggagctcctcaccccgtccttccagtccttttggctaaaatgcttaactatcactcacaaacaaatgtggagataccaggagctcatttgattcataccccaactttgtgttctgaaaaacatcagagggattttacattgcccagtttctccaccaacaagccttagggtggacccaaccctttccgcaagtggtaggaacgaatgcatcttagcaattacctgatttccaaagtccttttgtagcaaatgtcacctcattcgtggtctttttacctatcctaagcttatgatgatgagttatgtatgccaaatacttatctgaagagtttctcctcattgtgaatgtgtatgtaaaatatgaagacaagaaagggtgctttcatctgaggaaccaaggggtgagagtatcccaaaggaggacaccagcatcatcttttcttcgtactccaggacccaccaatattccagttctgggtcatttagagagataatggggcgtttattcccctattacctttgctaagtgctatattattggctgtttctcccgtaaccatgctgaaaagggggtcttagggagaactgtcatccaagtggcattcctagtaagttgggtagaaatgacattttccagagctgaaggagtgaagagcccttggccatactagggctctccttcccccggggagtgggaactcagccacattcagaattcacatcgcctttgttatgtccagaggagaggcataaaaaggcactctcccccaccacccctaccaaatctgggtttggtttggttttatttaactagcaaagttaatccagtaatcgcaaattactccagatggttaaagaaaaccctttcagaatacagaacgagaaaactagagtttgaccaataagaccaatttctgccatgaagaaccgggggacgcaagttaattgtttaacgtactctcattttaagcaccttctttcctgtctcttgattgttttttctgaaggaagtgtaaagaatgtctcagtctgccttaaaggaactgtgaaggcttctctgtaatttaagcttgatagaagtgaactgaaacattgtctaatgtctttgtggctttagagcttttgttatattgtgcctataaagcaaattatgtttacataaaaatataaataaagtattcagcatagcaaaacctcacctggcatctgctattccacataattcattgctggataagcagtcgcactattaaatatgcaatgaatggggaactgaaacaagaaaagttaaaaacctaatgggagcatctccagataagaaactaaagaccacatggagaaaataggggttaagaggagaaaagcctttaaaatcactttcaggttccctcaaaccagaaagtaaaaccattaggttaaaaaaatatatatatattgaaaacatcctatgggccgggcgcggtggctcacacctgtagtctcagcactttgggaagccgaccctgtggatcacttgaggtcaggagtttgagaaaacctggccaacatggtgaaacctcatctctactaaaaatacaaaaagtagctgggtatggtggtatatgcctgtaatcccagctattcaggaggctgaggcagaagaatcacttgaacccgaaaggcagaggttgcagtgagtcgtgatcacaccactgcactccagcctgggtgacagaacgagactcggtctcagaaacaaaacaaaaccaaaaaaaaactatcatatgttcatgatgacagtgatgatacagataacgataatagaataacaataggccaagcgcagtggttcatgcctgtaatcccagcactttgggaggccgaggtgggtggatcacgaggtcaggagattgagaccatcctggctaacatggtgaaaccccgtctgtattaaaaatacaaaaaattagctgggtgtggtggcgggcgcctgtagtcccagctattcgggaggctgaggcaggagaatggcgtgaacccgggaggcagagcttgcagtgatccgagatcgtgccactgcattccagcctgggtgacagagcgagattctgtctctcaaaaaaaaaaaaaaaaagaaaaaaaaagaataaaataacaataataatgccaaacatttataaggcaacctactatatgttgctaaaaactgtccacatattaactcacatgccttccccacagccctaagaggtaaggtctatcattatgtccacatacaggtgacaagattgaaacacaagggagcctgcgccctttcctaagatcacacgctactaagtgaaagctacaactcaccaatttccagccatacttttgccgccagaattcatgctcttaaccacctgatcatgctaccttgaaccttaaataagggtaaaatataacgcatttcaaattagtgatcccttgttcactcgaaacccgttagggatttggttttctctgatttcaaggatatgcttgtaaatttgtcttgcttggtagcaaataatatgcgtgtccagaagcatatttatttttcttaccttccatacaagtgtttggtgacatactgattttgaaactcacatgtctcatcaacagccttcgttttcatgatcttaaatcctcaaggttatcaaagagatactaagaagtaaatatccaccagctagggtttcacaaaagaggaattcatggctggggagggtgtattgtgctttaccatctttctcagcaggaagccaacggaacaggcctatgtcagtaaaatatcacatatataaaccagaattgacaaagcagaaagtcatgctgttggtgaatttcttaggaagtcacacactactaagtttcctggttttatttgtgggtttttgtttgttttgtttgtctgtttgtttttgagactgggtcttgctccattgtccaagctggagtgcagtggcacaatcgcacctcactgcagcctcagcctcctgggttcaggcaatcctcacacctcagccttccaagtagctgagaccacaggtacatgccaccacgcccagctagcttttttattttttgtaaagacaagggtctccctatattgcccaggctggtctcatactgctgggctcaagcgatcctcccgccttggtttcccaaagtgctgagattacaggcatgagccactgcatttgacctttgttgtatacttttttttttttttttttttgagactgaatctcactgtcacccaggctggaatgcagtggcgtgatctcagctcactgcaaccttcgcctcctaggtgcaagtgatgctcctgactcagcctcccgagtagctgggattacaagcacgcaccaccatgcccagctaatttttatatttttagtagagatggggtttcaccatgttggccaggctggtctcgaacccctgacctcagttgatccacctgcctcagcctcccaaagtgctgtatgttcttatttaatgctcacattctctgtatgaatctcatggctacatccagccagtgttggtgcactgtcacatttaaaaatggctcacctacaaaaactaaaacgaaatccacatgttcacttataactggaaatgggaaagaggtctactaggagttggaaataatttttttttttttattttgagataaggtctcgctctgtcacccagggagagtatagtggcatgatctccactcactgcagcctccacctcccaggctcgagcaatcctcccacctcagcttccccagtagctaggattacaggtgtgtgccaccacacccagctaactttaattttttgtagagacagggtctcactatattgtccaggctgctctggaactcctgggctcaagcaatcctcccaccttagcctcccaaagtgctgagattacagatgtgagccaccctgcccagcccaaattaatttttaaaggtttgaaggaggttagggtattaacatttcaaaagccatttggggtataggaaacatttgtgtatgagcaaggaggaaagaaatttgaggagcagagaatagaacagtgtagctgaaatacaagatggtggggagggagtagagtggaagacaggcactatgggaagtcagcaccaggtctgggggccgctgaatgccaagctgggaatcttaaatgttaaggaacaaggtcatacaatgaatggtgtgatgtaaacgcttgggaggcgatttctgagggtaggtgctgggtttaatggaaggagaaataagaagagcccataggtggccaggagccagatggtcaaatgccttgactcctcttgccttagtttgggtcttccagaatcagacactgaaacaagcatttgaatgtaagtcgtgttggggaggtgaccccaagaagcacagagggcaggaggtaggggaagtaggacagaagaggaaagaagcccattcaggctatgttggtgagcaggcaccactacaagagtctgtaggcatgatcagaatggtcccattgaagggtaaggaggcagtcatgattacccataaattcccatgcactgttggttggggactactcttaacaagggtgttaattccattcccatcttgctgcctgtatgaaccaagcacattgctgtcgccggacactggtcgcggaaagccacaagaagcgcttggtctgtatgggaactgctaggagatatggaagcagtgcccacagctcctattgtaacttgtctcaagagcttactttatattctgaagttaatgggggaagcttttgaggctttccacaaactgtatttcagtcttagtaaccactctagctatatcccattacctcacaccaccccttctttttttacatttgttctgtcaactgttctcttcacttggagaatagagtttctgctcagaggagatagccaaattgccttgccatctcatcaggatgtgttacttcattaggatcttcctttcaaattgtaggtctcttcttcattgggaccagaaaaatctgggctctctgttacacaattccatgtgtttcctcaacacattttaaatgagcatttactaaatgcaagaccttattccaggtcacagaaatagaaagcaaacaagacagattctgcctcaagaaattcagtctagagctgtgctatccaatagaaatataatgtgagtcacaaagttaaattttctagtcgtcacattagatgagtaaggagaaacacgtgattttaatataatttagcccaatgtttacagaatgttatttcaacatgtaatcaacagaaagattgagatagtttatgttcatttttcatactaacactccaaaatctggtgtgtatttcatttattttaaagacaggttctcgctctgttgcccaggctggaatgcagtggcatgatcctaactcattggagcctcaaactcctgggctcaagtgatgccttagcctcccaaagtgctgagattacaggggtaagccaccacacctggccctggtatatattttatacttacagcacatctcaactttgactagacacactttaaacgttcagtagcacctgtgaccaatggctaccattttggacaggcaggtgtagaagaagggcaggaatggactgtaagatataaatgtagctttaaagatgcaatgggagagggcataatgaagatgcaaagtagggagggaatggcaaggaaaccagacacagagggggcaatgcttgagtgaagtaatgaaagatgagcacatgtcaaccgtgagaataaggtacttaaagcacacaggatagggcctggcacacagcaagcactcagtaaacgttagttctctttcctacctccacttgtcaatgctgggaagaacgggatgcttgggaaaaactcagtagcctttttttttttctttttcttttcttatttttgttgtttttttttttgagatagcgtctcactatgtcactcaggctggagcgcagtggcgtgatctccgctcactgcaacctccacctcctggtttcaagcgattctcctgcctcagccttccgagtagctgggattacaggtgtgtgccaccacggccagctagtttttttgtatttttagtagagacgggatttcaccatgttggccaggctggtctcgaactgctgacctcaagtgatccgcccgcctcagcctcccaaagtgcagggattacaggcatgagacactgtgcccggcctagcttcttttttctacttttttttttttttaaaacaacagagactatatagatctcaatattttgcttccagatttgtttgtgggagaaaataaaataaatgttttggtattctctgccatgagcacagcttctattgccagccaagcaaaaatgctgggaagtatgttattcaaattggcacccaaacacccatacaaagaagaaactcagacaggagtaactgaaacatcaacacagcacaggagtgcacactcacaaacaactgtgcaagagcataagccttagaatctttcaaaccaggggtcaaacttggggaatttgcttggggtctgacctttctcctattaaaatggagaagatcatattgtatatattctagatcaaatgtaacagtgtaggtgtaacccggctgaaatcatgacccacaattccagtccaaaagccaggtaacaaatgcctccaaaaccaggtttctccactcattaaaacactgatcaaatgcctagtatgttcccgacatattatttttagtgtcttagctgcaaaaataagtgcatagcccctgccattcaggaactcagtttaattatgtggtaataaataaggtacttattgtgcaaatggcaatttgtttgtagagcctgccttggtactgggcatttatgtgggccgagtggcaaagaggctgtaattgatgagaaatatctatcaggaacaggcaaagagagacatctaggagaagtaactatcattaggtccatcagtgaggaagcccagggtaggttcatggaatggtccacttaaccactgcatgcatcaagaggaaagatagaaaatcaataggactggattatggaaatccatggatttcacttcaaaggttctggattttgtactaaaagcagaataattcactgagggatgaatcaagagattgctagagagtgtctcaagtaagagaagaccatgggaagtcttcccagaatgagctttactatttcacttggttcagttgtgggaggtggaacagatgaaagtgccatattggaataacagttctttggccagtctcccagcatccacccattgtctatttagtcatgagataaggtgcccatggaattggcatggatgggaacaaaagaactcctctccatttcaggagttgtgagacaaggaggggctgtggttctgtctttctggagatatggggcatcgtctccatggaagtagaagctcccagaaagtaaatcaccattcatgggagttaaaactagtgcaaatgacccatgcagcatattcacaaacactgacactcaaaagattggaatcgttttcaaaaacgtgcccgagctcagagttgacagatgcccatagaatggaattgaatcaagaccaaccatggaaatgaaactagcatttgccgaggacttgctacttgccaggcatttgacacataccctcactgaatcgcggcagtgcctagaaaatcaggcattatcctcacttacagataaggatcctggatttcagagaggttaggtggcctgcctatgtacactcagtcggaaagcagaagagtccggtctagaacccagggctccatgtgacagaaagactcctctcaatggctgggacaagatggaggccaggcattccaacgaccacctggcaaagaaaaagaactttctcttcactagctttagtgtgaaccaaggtgctctcaggaaggctccgattagcccatctttggtcacatgctagtctgtaaaacagtcactgaagcagagggatggctattgattggccagcccgggtcacatacccacacctgtaggttccagcaacctgattgataagccaatcaggaccatgtcaagctgcagaaggatccttataggaagtgatgctggatggttaaacctatgtccactacagctacagtatatggaatactcattgtgtaccagacactgtttgaagcccctgtagaaatcaccactgacacccaccacatattgtcttggtgcaccagagttcacctgcagctatagacagttcctggcatggggacagctttccacatcaagcacctgcactggtctttctactgtgcctgcaggcttcctccaacatcacaggagacgaatgcatgggggtaacccagagttactgtggtggggggcaggtcgtagcttcaaccagtggaagatggcagccagtggataaatgccaagatttcccaccttctagtcgcatgatttgaaggtgtgttccacacagtagctcaaagggccccttggcaggatgaaatgcaaatttcccacaatggcaactcagtcaacagcatgccccttactggcttttcttccttccttgtctcattctcccactcctgctcctgctttctgagatcacattcccaataaaccatttccacccaagtccttgtcttgagggatactattgtggaacccaagtaaaagcattttacatgtcttaacttgccaactacacccagaaaaaaccctataaagtaagtgatgctatttccatttaactgatgacaaaatgaagcacagaaaagtaaaataaagtgcccaaaactacacagctagcaactgagtttccagaattagggcttagaaaccaagccaagttctctctaatgtccaagtcactgaaaacatgcattactgcttaagctggaaaaaattattcaacagctaagctagtgtcataattaaattgacttctgggaccagcccttcacagtatttcaaaagcctgagggagtgagaagggattattgctgttttcctgatcctggagaactctatccaaggccaacaggagaggacccagcagcagtgatgaattaatgggctatgctgggaaaaagggaatcagaccagccccaagaatcacaatacatttgttctcttcatcctttgctaaaacaaacaaaatatcaatttactgagcccaggctgctgctcaggctgaccgcggatgttaagagctgttctgcttgtctttgtttggaggcagaagtttaattatcccaatggtcctttgagattaatcaactagcaatgaaggaagtcagtctatcattaaattgcacttagataatttaattattaactagataaattcagagtgtatttttaaaactcccattcttactcaggacctctcgttctctctctcactctccctcctaatgttaatattatgaaagagacttgattcagttctacaaatattactaagccttggctatgtgtatggccctgttttgcatgttgtgaagaagttaaacacagcctggccactgctggcaaaaagcccatggttgggccgggtgcagtggctcactcctgtaatcccagcactttgggaggccgaggcgggtggatcacgaggtcaggagatcgagaccatcctggctaacgcggtgaaaccccatctctactaaaaatacaaaaaattagccaggcgtggtggtcggcgcctgtagtcccagttactcaggaggctgaggcaggagaatggagtgaacccaggaggtggaggttgcagtgagctaagattgtgccactgtactccagcctgggcaacagagcaagactctgtctccccacctccaaaaaaagtccatggttgagaagatggtgtgagacagggacatcaatcaccaggaaaaagctagaagcataaagagaagagatgcatggggcttgggggcgcaacagtggaagaggtggtgtttggatagaggataaagaagctctatggaatggaggtgggatggacactcttggttttgcctgccaaatttggctcatagttctgtggtcaaaactagagactctgaagacagatggcctgggtttgaatcctgaccagctgtatagttactagctggatgaccttgaccaagttatttgatctctggacctttgctggctcctctgtagcagggtatgatgatgctgaagtgttatcaggttatggtgtatattaaatgagtcagtaggtgtaagatgcttatgtgagtgcctggtacataagcaactgtaattgtgatgtgttttgtccattgcccctgattttcctctggggaaagacccaccctttatatattgtgttggggtttctgtaaatcaacgtgcctagcccttgcttactcaagtgaggctcatgacccagggaaggtcaaatgaatgttctagtaatttgaagtttaagaagagagatgcaaacacagacaaatagggtagagctcattcattctaaagacaacgtccttggccgggcacagtggctcacatctataatcccagcacttgggaggctgaggcaggcagattacctgagatcaggagttcggaaccagaatggccaacatggtaaaaccccatctctactaaaaatacaaaaattagccaggtgtggtggcaggcgcctgtaatcccagctactcaggaggctgaggcaggagaatcgcttgaacccgggaggtggacgttgcagtgagccgagatcctaacattgcactccagcctggtggacaagagcaagactttgtctcaaaaaaaaaaaaaaaaaaaaaaaaaaaaagacagtgccctaaagatactctccatgaattcctgatacccagatccccaaagctgcttaagtttctatttttctctgagaccagaagttttaaaattggattctgtgagcttaagttagccagacctgatttctgttacatgcaaccgaagaaccctatctgataaaaagagagcctttgaactgggtcttgaatcatgtgccagggttataactcagatggttccacttcccggttacatccatataaaaagcacatttattttaaaaagatcaggacacatagctggcaaaggatttttatcgcacatcagtgacaagagcagcctaagagagtatgaatgccaaactatagtcattcctgaaacagtccagatttttcattaagacgtaatggtcaaatatttgaagtacaaaaaaatacagccaacatattcatggatcaagagcagtatttgccaaatttcaattttttgtgtaccactttgtgatttttgccatacctaggtcccgggtatcactaatattttttaatattatatatgtagatatatatacacacatgcacgtatacacacctccccctcaacacataccccattacatcattaatgcttctctttaaatccacctacttttaaagtcatataaatgtatttttaaattatattactaccataaatggaaaataaatattgtccatgaatagaaggcaattataagcattaataccatggagcaaggttagggagtcccactggtcaaatatggagcaatttcagcacaaaataaatacatagtagatcataacccacgaataaaataaaaacccatgagcccagcaataactaatatgcaactgtagtcaaatgccaacaaataaatacaaacaaaatggagttagaaaatcaagtcgttggtgaaagtttaatgagtagcaggttttccttgcctcaaatgtttccccacaaattaccaattaattacaaagtgaaaattgataactttattgttgagaagcccagcaggctacatcttaaccaagggatcaaaggtgacaccaccaatgtgaaccagccgacactacttgcttcctaatagtatgcactgagagggacacaacatcacttccttaatatccacgccaaaatatgcacaactaaatttattcaggaaaaaacatcaggcaaacccaatctgaggaacattctaagaaaataatcccagaaaatggcctgtactcctcaaacatggcaaaatcaaaagggccaaaaaaaaggctaaagaactgttacaaatttaaagagtccaaatagtagacaagacagctaaatacaatgtgtgatcctggactgaattctggagtgaggcagtagcagttggggggaacttatacagaacattatcaggacaattgatgaaatttgcatatgcactagattagagcgcagcgttgcatcaatatcatgtttcctgattttgattattgcattgtgtgtatatgagagaacgtcttaggaattacacacttgagtacttaggtgtaaaggagactgatgttgaatgttgaagacaacattcattttctcagggttccaaaataaatacgcatcaagagacagaatgaagattataaaacaaacggggcaaaatgtagtcaggtgaatctggatataggataaaaaaattccttatataatttttgcaacttttcaataagctagaaatcataataaaaagttaccaaaaatcactaacaaaattaatatcataaaacatgttattagagttgtcgacgaaaaaaatctaacttttgtcagatacagtgagttctgcttcaaagctttagtttttgacctctttgttcttcattctcaagatcagcttttccttgtcccttctcctaagctacctgctctttaaatatctcttgccagtcccaatctgtaattcacatctccgttgtttggaaagagtcctctttgctcctggctacccattctgtaagctgcccctcctgcctaaacagctcttcctgcctttgccgtgccctgacatgcccaaacatgccttgtaccataatggacagcctctcccttcccatctaattagccatattcaattttaaactgtagccaatcggttcagtttagattgtccagtccaactccaaccaacggggacaggacacagaaggagggactaaccacattagggataaaaaccccttccctattttgtggggtatgccctcccagcaaccagaagtgtaagcagcacccttctgcagaagtaaatctggcttgctgagaaatcctttgactgctggtttccttccaactccaagctcttgtttctaacgctttgtaaaatatttgaagagatttattctgacccaaatatgagtgaccatggcccaagacacagccgtcaggaggtcctgagaacttatgtacaaggtggttggggtgcagcttggttttatatattttagggaggcacgagacatcaatcgaatatatttgaggaatacatttgtttggtccaagaaaggctgtacaaagtgagggggcttccaggctgtatgtaaatttaaacgttttctggttgacaattggtcaagtttgtctaaagacctggaatcaatagaaaggaaaagttcaggttaagataaaagactgtggagaccaaggttcttttgaagtctcatagtggctgcccttagagacaatagatgtaaatgtttcctactcaagacctttaaaaggtgctagactctcagttaatctctttgggattgggagggcttgaaagaaaaagatgtagctatgttaagagattctttacagatgtaaattttcccacacaaaggacagctttgcagggcgatttcaagagatgggaaagaaacatgttttggggtaaaatattttgattttcttctttgtcacataatgttatgccagagtcagattggaatgtgagtcatgatatatagggttaaataaaacccatctgatgagaatttatggtttgcagggcaggacttcccagaccccttagatatttgggcaagataagaaaaaaaaaaaaaaatcagaccttaatccccagtggcaagttaaaaactattgcccatcaaattctctaatactggagaccagtttcttaataaaaaagaaagaggcacattttagaaagattttaaaaggcataccaccatcaagataaaaaactacctcgatactataatcaaggtttggagagcattggaaaagaaaaagcatttcccccagtgtgatccaaagctctttaatgtatgtgcgccagtggtaagagcattcaacctggggaaaccttctctcaagcaaatgaggcttgcagaaactttgacccattgagtagctaaaaccagggaaggcggtaggacagagcagcctgacatttttgcacagctcttggctgagaagatgtgccagtatgttaaatttaatacactggttttgcctgttagaaatccactttgctcacaacagttttgaaacagacctcacttttgggtggtgacaatattgtctgcagccaggcgtttctatttaaatgctggctaaacccagcttcaacaatgagtcatcaggagagaagttctgttccccacatcaggagacccagatggaaagagaaaccatctgcccaccaatcctgtagtctatatccagctgccaagcatctgcagtcccacaaatgagatagaactccctgaaatggcccccccaaaatggtcccagtactttaaaagggctaagcttcagtgccaccaactaccaaagcaacctccatagaatttttaatgtggtactgagagagtactgggaatccccagtcatatttatttatctgttaacaccaggaagaatccctgctaagcaatcttgatggattatttcatttaatcctctcactgtcagaggagtttgaaacagagcaactccgtcctgagtgagggctaggaaaatgaggccgagacttgctgggctgcattcccagaaagtgaggtattcctagcttctagatgtttatggttaagggagcagattcatagtgtttactaaacagacccagacttgggagggtcccgatatccccatatcttgagaagagaagcattcctaattttgcttgaaagataatattgattcttgcaaaatatagtaattaagaaaattaatcctttatcacaaaccattgtagcagagctcatctccccatgatcttttcttttttcttttttttttcttgagacagagtcttgctctgttacccaggctggagtgcagtggcacaatctcggctcactgcaagttctgcatcctgggttcatgccattctcctacctcagccttccgagtagctgggactacaggcacccgccaccacgcccggctaattttttgtatttttagtagagacggggtttcaccatattagccaggatggtctcaatctactgacctcgtgatccgcccacctcggcctccaaaagggctgggattacaggcatgagccactgcgcccagcctcccatgatcttttcttatctcatatatatatacacatacgcacacacacataagtattgtacctaggtggatgcgttcccccttagtttagggaatgccctactctgtctatggaatggctgtactttcaccactttacttttttaataaacttgcttttgctttgtactatggactcaccctgaattctttcttgcatggggtccaagaaccctctcttggggtctggatcaggacccctttctggtaacatcaccacatgagactgtgcttttgtttcatagatgaagaaactgaggctaagaaaagttaaccaactcaccctggttctacagccagctacatgataccaggattcagatccaagctgtatgcctccagaaactatgttcttggccactatcaaccactaagctgggttgccccaaggaaagtaaaagaggcaacccacttggtgggttgccaagtgaaaaacagaatatgcagttatattggaatttcacacaaacaatgggggaacaattttttagtataattatgttccaaatataacatgatacatacttataccacaaaagttattgtttatctgaaatttcaatgtaactgggcatccatccaacccgtatttttaaatctggaaaccttatagcaggtaggaccaaacctatgcaacccctagctcagaagacatgtggcttgactattaggccacaagaagcaactacagcttcagaatccaggtcttctgtaaaccttcccaaatgtctacgtgcctaataaccatcaggtcattttttaattttggggcattggtgggatggtggtacgtgagttctagcaagatgccagagaatcccacaaggaattattataaagaacaaacagggatatctgtgagaaaaacctactgaagcagcattgttgtctggggtaaaaaccgggtttgtcatctcactccaagaaaattaaggacacagacacatgtggataggttaaggagtggaaagtttaacacgcaaaagaaaggagagatgagagcagttccttgtgagagagatgctaaggaaaaaaaaagtgggggaaaggtgtggaccacagcagattttataggcaggcttgaggaggcagtggctgatttacatagggctcacagattggtttgaccatatgtgatgtttacatagtatcgggaaaaggctggtcaccccaacctaatcttattatgcaaatgggctttccacttggccagggccatcttgtctgctgcttacttctacacgtggctggcaaaaaaagaagatggagctgccattttgaacatgcctattcccaagtagtatattcctatgggcacaactgtgggcattcacccatgcaagcttccagcttgcttatgtctgcagcttgattttacaggatgttctttgctagaaaggaatatgatttaggggctgctttacattaaaagggaaaccttaccaaggactttgccagagatgatgaattcctcttcaaagggttaattgtgtaatgtccttgtccttggtttggaggcctcatctccttgtactttgtttctagtctgagagcagccctcctgctcttgttgtgccctgacttgcccggacacgtctgaacatgctttgtgctgtagtagagggaccactactgccccctccctcccttgcgaatcacacatttaccctacttggaaaagtttaagtcttagtcaatcggggtcagcttagattatgcagtctaaccctagccaataggggaaggacacagggatagggactgcgttagggataaaaactccttctctcctttgtttggtgtgctcttgcagctgccagaagtatgagcagcacccttctgcagaagtaaatttgccttgctgagaaatcctttgagtgctcattttcctttcaattctgagctcgtttctaacggacttccataccttcactatctaagtaatttcttcttagctcctaaatcacaacagtactgggtccaaagagtgagatagaagcctgagcctcacatctcaaacccaagacaagccctggatggagtgttgcagctgtgtgacctccatgacaccacttttcctctttgagcctcaacctcctcctgtgaaaaaggagagcattgaactaggctggaggatctcaaagttggtctctggtctgcctgcaacagagtcacccagagaaattgtcaaagaggtagattctgtatttttttttttttttttttttttttttttgagatggagttcctcttggttgcccaggctggagtgcagtggcaccatcttggctcactgcaacctctgcctcccaggttcaagcaattctcctacctcagcctcccaagtagctgggactataggtgtatgcctctacacccagctaatttttgtatttttagtagagacagggtttcgccatcttggccaggctggtctcgaactcctgacttcaaatgatcctcccactttggcctcccaaaccgctaggagtacaggtgtgagccatagcacccagcccaaagaggtagattcttgattcccaccccagacaaaccaaaccaacaattttacaggagccagaaaaactgaactttagtaagatccccaagaggttctgatgcatcctgaagtttaaaaccaactggaccaatcttgaaaagtagatgctaaatgaaagaagccaaagacaaaacttcacatattctctaattccattaatatgaaatatccagattagattagtctatacaaacaataggtagatcggggatacagggaggaggaatgaggagtgactgatagatatggatttccttttaaggaaatgaaaatgtcctggaatttgatagtagtgatggttgcacaactcataaatatagtaaaaaaaaaaaaaaaaaccacgggcttgtacactttgaaatggttaattttatgatagttcaattacatcttaatttttatttgttttattattattttttgagatggagtctcactctgtcacctaggctggagtgcagtggcacaatcttggctcactgcaacctctgcctcctgggttcaagcaactctcgcgcctcagcctcctgagtagctgggattataggtgtgggccaccatgcctagttaatttttgtatttttagtagagatgaggtttcaccatgttgtccaggcttggtctcaaactccagacctcaagtgatccacctgccttaccctcccttaatttttaagtataataatgagtttaaaatggtaatgggaaaacaaaatcactcaactggatgatcctagattagggttccccagaatgtgctccccagaattctctgccaaaatcctccgtaagaactgagtattagagttcatcccatggccaggcatggtggctcatgcctgtaatcccagcactttggaaggccgaggtgagcggatcacctcaggttatgagtttgacactagcctgaccaacatggtgaaacccaatctctactaaaagcacaaaaattagctgggtctggtggcgcgcacctgtaaacccagctacacgggagtgtgaggcaagagaatcacttgaatcagggaggtggagtttgcagtgagccgaggttgcaccattaccctccagcctgggtgacaagagcgagactccatctacccccccaaaataataataataataatagagttcatcccagaaggtcatagggcagctactagagaggaagagctctgggaaggtgtgttgataaaagagagaaaatctttggcccagatattcctacacttactttcaccctaaagaacacctgactaagtatctatgaaacagccatttagaggtggaaatccatgtgaaatgccatttcctcaaattcacggtcaatctctgcaattggcatatagataagagggccccttgcatcacaaccttcggctggggaagtggtctgcacagacactgacctacctaaatatatccgcctcctgtaatcatgaccacttcatggtcatttaactcctcttttttcaaacaaaacttcatggcaagtccatcccaagtcaggcagagaatttagctacacttagtaaatatttgcagatgtattgatgaactgaagattaagttcaaaggtaaggtatgcttgcttcatagacacacagctccagcgcagagcatgacccaggatgttagagtagaagaggaaaatatgatgtgatgcaaggagacagacctgggttcaaaccctgccttcatttgttcaacacgttttgattgtgcaccagcgatgtgacaggcattagactaatgaaacggaggagttttcccttattcctccctcagggcatgcaacaggggtgtggctcacttctttggtgccctgctgctcaaacccctagggggagcatacagacgggcaggttataaggagtgcttttgggctctcaccccacagccgtgtctggggttgaatgtttccagctcccaaagccccagcggatgtgtattacagtgaactctgtcagttttgccgtctgcaggcagcttgtattaattgctcaattagaccttctatcttaccataaggaacaaactaatacagaggcctttctgtattccaggtgcttgccctaagtgtaccagaaaaattggatgatacacgggcttagaggatgggtgcaagattttactgagtggtggaggtagctctcagtgaagtggatgggcagccagaagggggatggagtcggaaggtgatcttccccgggagtcaggccgcccaggagctggactctcctttgactgtcccgactaaattatacattgtcctgcctcgatggtctgccggtgtctgctagtgtatgtcagtgtgttcttctgctctctcttcatatttagctgcttgtatctgtgcccactagcgtctcaggtttttatgggcacaggttggggtatggcaggccacagtggttttggaaaatgcaacatttgggtggaaaaacaggagtgcctgttctcactcaggtccatggacacaagcccaagagtggagccctcaccagggacccagcccttctctacctagcatttccctgcccccctcccgtatcactaagtatgggcatggttgggtatatgcctcaatttctctggagctatgagtagagtttctgctgcttagctgtgtgaaatgaccttgggtcatttacagaaggtctctggattcgttttttattactgcataataagttaccacaaactttggggcttaaggcaatgtacatttactatctcatagtttccatgggtcagcaatcggaacatcccttggctgtgctgtttgcctggggtctcacaatcctgcaatgcttttgttagcaggctgtattccctgctgaagctcagagtcctcttccatgctcacagggcatctcacagcatggcagcgtacttctcccttcatggaaggccaggacccttttataaagggctcccagtattaggctaggtccatacagggtcatctgtgaactcaaagccaacaaatttgggacctttattgtatacgcagaatcaatcccttcaccttgtcatattttactggtttgaagcaaatcacaggttccatgcaaactcaagggaaggagattctataagggtgttgatatggtttgcctgtgtccccacccaaatcccatcttgaattgtaactcccacaattgccatgtgttgtaggacgaacctggtgagaggtgattgaattataggggcgggtctttcctgcactgttctcctaatagggaatgagtatcacaagatatgatggttttaaaaagaggagttccactgcacaagttctcttattttgcttgctgctaagaggtgaagccagctggacttcctgggttgagtgcagacttggagaacttttctgtcttacaagaggattataacatgcaccaatcaagcactctgtagctaggattgtaaaacacaccaatcagcgctctgtagctagctagagatttgtaaaatgcaacaatcagtgctctgtaaaaacgcaccaatcagcactctgtagctagctagaggtttgtaaaatggaccaatcagcactctgtaaaatggaccaatcagcaggacatgggtgaggacaaataagggaataaaagctggccatctcctagccagcagcggcaacccgctcgaggtccccttccacgccatggaagttttgttctttcactcttcaggataaatcttgctgctgctcactctttggttccacaccacttttaagagctgtaacactcaccgcaaaagtccacagcttcattcttgaagtcagtgagaccacgaacccaccagaaggaaccaactctggacacaatgccatccacgtaagacatgacttgctcctcattgttttccaccatgatggtgaggcttcccagccacgtgaaactgcaagtccaattaatcctctttcttaagacttgggtatgtctttatcagcagtgtgaaaaataatacaggtgtagatactagggggtgggagggcagggtaatcaacttcaagttctgcctatcatactctgtaagtatcagttcctttcatcgtactttgatattgttcatggtaatagtactgctaatggtaccaaatattttcttttaatgacagaccttcttagagcctttcctcactagtagctgccctgtgaccttccgagatgagttctaatactcagttcccatggaggcttttatcagaattctggggaacacactctggggaaccctgacctaggatcatctagtccagtggaggtttttctcatgttctttgcattttgtagaacagcaaaatgggaggagcttaaaccaccttgcaatattgtcaagagaataaaacaagaaatcgtatagaatgagcaaagctgccaattctcccttaggaagaatagcaaatatttaccatgattcttcatggccaagtcacagaaaaagttgaatggccactatattatagcgattaaggacatggctctatagtcaaactacaaggattttataaatcctggccttactgctgatttacgatctgtaggtcctcgggcaggcttgtcataacctcacgtaaccacaccactttccttataaatagagtgaggataacagccatcagtctgttgggctatcaagagaattaagatcatatacataaagcatttagcttagtgtttggctcatagagctcacataccatcaactcattagcatagctggacaattttaacctcagtaagaaaaggaagtctcaaaagattacagtgacaagtacatatttcaaaaactttaaacttcactataaagtaaaaacaaaagttgtaagaaatccttgaacttggactctggactgtttcccaataacacatgctaatgtgatagctaagtcactgagcctgcagtgcaaatcctgttgcacctccttaaaaaatcctgaaacaagtacaggagccctgcccttcaccttcaggagtagagaatttgatgtcatagtgctacaggtccacattgacatttgatttctccaggaggggaaaaaaaaacgtatttggtcataaagaagccatgagttatttgttagatgagggtgggcaccctattttgcttttatgaagctttcctgggagaaaaaactctgctacatttttagtacctaaataggggatgcatcaggattggaggcagttaaaatagcaattaccaacagcagctctctccggtctacaatatcatagaggatttctatttcctacattatttgcttttataatctatggatttgtagaatgtacatgcatcattgtgcacgtaatccagaaaacaaaaaacatatgtgtatgtacatatgcacgtgtatgcacgtgtgtgtgtgtgtgtgtgtgtgtgtgtgtgtgtgtgtgtgtgtgaagctggaggtagctggagcatctctggacctccaagagggctgatgagagccccagaaaggctccccagaaagcctaagggagtgtttctcaaacttcagttgtacctcagaatcctaggagacttgtgaaaagccaacacaattgcagactaaagccctcccagagattctgatctacggagactgccattgcctaggaatctgcatttttatgtacagcagccccaggcgattctgctgcattttgaaaagtgctggttaggacccgggcctctcctgtgatggaaatgatctgagactgcacagcccagtgtcatctcaccatgacaggggaggccctgttctatacctgggtctgtaggtcaggagtgtgggatggctcatgggaaggggagaaagagcttgcaactaagatgttccaatatatttttaaaaattagatgctaaatttataaaaatatacagatctacagttgcatgaaaagctttttctcaatcctatctgtgaatttctatggcaatggaaataaattcatttgaggataaaggggaaagtctaagtgtcagaccttttgtgaaagagacctcaccttctgcctccctcccttccccctcttccgccgccatgacaagccccagcctaaaaggacattcaaggctcctcccagaaggctcccagccagccagcaaccgggtaccaagcttggacttggcgtcagcctcctgccacctagtggtcagtccgggacacacagctaatttatcttaatttccactccactctcattggttgatccagcggacatttgtctagctcctgtaatgttgccaggcaatttgctgggctatggaggtaacaacgacttcgtcttatagcgctgaaaggaatgtgctggcattagttaaatcattcccaatggtgaaactgaggcctggaggcagggagtatggcttacacagggttctgcatcaactctgataactcgcttaaaatatccttttctcagccaggcgcagtgggtcactcctgtaatcccagccctttgggagcccaaagcaggggaggactgcttgaggccaggagttcaaggccagcctggccaacatggtgtaaccccctctctactacaaatgcaaaaattagccaggcgtggtggtgcatgcctgtaatctcagctactcgggaggctgaggcacgagactcacttgaccctgggatgcagaggttccagtgagctgagatcactccactgcactccagcctggacgactgagcgaaactgagcaggggataagctaagcccagactcttgacctgtagaaactcatcatgaatatgatcatatcataaacaagcctcagagtttgtggtcatttgttacacaaataggaaactaaaaaaaattcaataaatactgaaaacgagagagatgagagcgggaaagtagaaagtgagggaaatggcagaggaaaaacagtaagtaggtgggtccattctgtaaggtatttatttgattttagcaccaatgaactcaggaggtcgaaagatgtaacactgtttcaccctctctgtgggggtgagatgggatgtgaaccttcagcaccagtgactgtctcttcagcaagctcagcagggaggaaataaagtcctattgatagttctgatgcttaagccccagagaagcctccagcccagagataagtaagcttctctgggtgttcatatgtggttcacttgtctgcctgtagaacactggaacaggagctgttcatctccacccaaaccactaagaatgcatttctcacaactcaggttttgtatctacgtggaaaaaaaaaatgctgggcagaaaaaaagctgtatgatcttccttgggtgaaaataaattttatctcagatactagtggacattaattaaaaattcatggaatagctctcaagagagaagatgtcagtaaacattagaatataagctctatgagggcagggatatttgtcagtcaggtttactcttgtatctttgcacctaggacactttctggcacatagtggggccaaccgatatttaacagataaatctgaaagagggtggatagaggggctgctgcagtctagtcaaaactaatcagggtcctctctactcatcgcccagcaaaccaggtctgatcgaatatcttcctgtcacctctacctacctactctcaacttgacaagccttgagggaaatggcgttattccagaggaagcaggaagcagtatgagtcctaaattgtgactgtgagccacagttatatcaccatactcaggccccatctccaggagtgtctgattaatatttaaccaagcattgtcaggtctataaagtaaaggagaaacccaattctcatctttggacttccattcagagtggaacatttcatttgctaaaaagccaataccttgctttattagacagttgtgctcaacaagtccattcaacatctgtaggatgcatttataaatacaccgagctcagcggctcacacctgtaacctcagcacttttggacgccaagacagaagggtcatttgaagccaggagtgtgagataagcctgggcaaaaaagtgagacctcacgtctgtaaaaaaaatatttttttttagattagccaggcatggtgtcacatccctgtagtcccagctactcaagaggctgaggtgggaggattgcttgaggccagaggttgaggctacagggagttatgattacgccactgcactccaacctggattagagcaagaccgtttcaaaaaaaaattagtggaaaaccagaatttgactttgtcacgatggttcctaatgactagaagtaacaaaaaacagcaagagggagagtagaggaggagaatgaacttggagtcatgtgtgccagatgccatatcctcagccatgaatcagacccactctgatatcagatcccatttctgaaaggtgtggtctagtaaaaaatacaggcactgttaaattacaaattacacaaagtacagtgcttagtgtttcaaagagaaagtatccagtactccatgtccccctaaagtttataagaaagttctgacggtcagcagagtccttcctgaaaaggttgaaatctaatggattttgtctggtaaagactctacagcaaaccttactgactacctatctaaaagctgcccctgctgattctcttgttaacagaaaacttggtatttttgtttgtttgtttgtttgtttgtttgagatggagtttcactcttgtagcccaggctggagtatagcagtgtgatcctggctcactgccacctccacttccggggttcaagcagttctcttgcctcagcctccccagtagctgggattacaggcgcccgcccccatgcctggctaattttttgtgtgttttcagtagagacggtgttttctcatgttggccaggctggtcttgaactcctgacctcaggtgatctgcctgcctcggcttcccaaagtgctgggattacaggcatgagccatgggtgccgggcccagaacatctgttttgttcaagtatctggtacttttttgcgctcagaaaatgttctcctggccccagtctaggaatgaccctgtggcccaattttgaccaatgaaacattaaggggaaatccgctagggggcatctgagagcaagttccctctctaataagagggaggtatgtgagcaccatctttccttcccattaataccccctgctccctcctttcaaagtgatgctgtgaagacgtgacacttggaggtgctgcagccatcttgtgactgagggggaagcaatagaaattgcaaagatactaattcagtacccaaatgtaaagccactgggcccacactagaatgaactaccctctctctctaaatatcttcttatatgagaaaaatatacccccatttgttcaacatggtgttaactggatttcttttctttttttctttttcttttttttttttttttgagatggagtctctctctgttgcccaggctggagtgcagtggtgcaatcttgactcactgcaacgtccacctcctgggtttaagcaattcttgtgcctcagcctcctgagtggcttggattacaggtacccgccatcatgctcggccaatttttgtgtttttagtagagacagggttttaccatgttggttaggctggtctcaaactcctgacctcaagcgatccacccacctcagcttgtcaaagtgctgggattacaggcatgagccaccgccccggcctgattttctttacagcagtacatacaactaaccgattcagatttgtagcatgactgtcaggattttagaaatgagttttgtatctattgttagataacaaacaagcctaaaactcagagccaaaaatacaatcatttgttcacaattttgggatctaatgctgtgtaacaattacccctaggccaagtgcagcgtctcatacctgtaatcccagtgctttaggaggctgagggggaaggattgcttgaggccaggagatcgagagcagcccgggtaacatagggagaccacgtttctaacaaaaaacttaaaaaaaaaaaattagccaggcgtgatggtggacacttgtagtcctagctactctggaggctgcaggaggaggatcgtgtgagcccagcagctaaaggttgcagtgagctatgatcgcaccactacacttcagcctggaaaacagaatgagaccgtgtctctaaaaaaaaaaaaattattccaaactttggcaactcaaaataatgatcaacatctagtgtcttctaagggtcaggagtttgggagtggtttagctgggtggttctggctgaatgtccgctggcttcccccagggcaagcaatccaagagagacaagtggaagttgcaatactttttatgacgttatcttggaggtcacatactcccatttgcacaatatcctatccattacacaggtcatccctgttcagtgtaagaggagactatgtaagtatgaatgaatatcaagaagtaaggagcagtcattgggaaccatctggaagtgggtcaccaccacctaccctctaatgctgtgtcacacaggactcagggaaacaaagcgcatcaggagatacacatgtgtgtatacacacacacacacacacacacactttattttttaaactccattttgttttttgagacagagtcccactctgttgcccagactggagtacagtggcatgatctcggtcagctccctgcaacctccacctccccagttcaagtgattctcatgcctcagcctccagagtagctgggattacaggtgcacaccaccacacctactttttttatgtttttagtagagacagggtttcgccatgtttcccaggctggtctccaactccttggctcaggcaatccgcccgccttgacctccgaaagtgctggaattgcaggtgtgtgccgagcacacacacacacacacacacacactttaaagggtttattacagggatttgaccctgtgtaattgtgcataccggttaaacagtctataaactgctacctatgaagctctaatgctggcacttggggtccacagggccagccatggagatgggcacctctcactgcatcctgctttggtatcttgcaaggaaagctggtggctcaccttaactggacacacacagggaagtctgggacacagctgagcatcgccaagtgacactttccaaagccactgaagatgtttacccttcgtagagtcgtggctgggacaggcacaaagacaagtcgggagagctgccagtctccagcttgctttatagccaggtctagaggcgcattcctatttatgttatgaaaaatcagaaagtgatatgcttccaatttggaaacgtttctgtttatatttcaataaaacgtctatttaaaacattgatatgttttatgcagaagacttagaaaaacaaagagaaggccaggcgcagtggctcacgcctgtaatcccagcactttgggaggccgaggcgggtggatcacgaggtcaggagattgagaccatcctggctaacacggtgaaacgccgtctctactaaaaaattacaaaaaaaaaaattagccgggcgtggtggcgggcgcctgtagtcccagctaatcaggaggctgaggcaggagaatggcctgaacccgggaggcggagcttgcagtgagcccagatcgcgccactgtactccagcctgggcgacagagcgagactccgtctcaaaaaaaaaaaaaaaaaaaaaaaaaactaccatctcatcctctcaaaggaaccactattattttgacctatccctaccatacagatactcatctgcacacatccctcacccatggctctctaccgcctgcattttttttcttgagacggagtcttgctctgtggcccaggctggagtgcaatcacgctatctcagctcactgcaacctctgccctcccaggttcaagcaattcgcctgtctcagtctccagagtagctgggactaacaggtacacgccaccatacccacctaattattttgtgttttttactagagacggagtttcaccatattggtcaggctggtctcgaagaattcctgccctcagctgatccacccaccttggcctcccaaagggctgtgattacaggcgtgagccaccacgccgagcccctgcattcttttgtatgaactgcttttcccctttggaaatattccatgggtattttctgtgttaatcaacgttcttttatagcagaattttaatgatggcttaaaagtccaatatattaatccccttttagtaatatccttttaatttttgattagaaataattctttttctgagctgggcacggtggctcacgcctgtaatcccagcactttgggagaccgaggcaggtggatcacgaggtcaggagttcaacaccagcctgaccaagatggtgaaaccccgtctctactaaaaaaacatgaaaattagctgggcgtggtggctggcacctgtaatcccagctacttgggaggctgagaaagagaatcgcttgaacccaggagggagagtttgcagtgagctgagatcatgccactgcactctagcctgggcaacaagagcgagactccatctcaaaaaaaagaaataattctttttctggttcctgctaaactaccatgaataaagccaggccagaggctgtctttgcttctttattttcagtaagggacactcaaggcaagtactaggtttttcaacaataatccgagctatctggtatatattttggagggtggcccaagtctcgctgggcagaaataaattatagaaagaagccaggcatggtgaatgtgggtctttcagggacatcagcctgtctcctggacttgctgtctccacacctaactggcccggctctgcgagcgtttcctgtctggtttccatttgaagaaaccctttagcgaaaaacagcatccagtgcaaattggacagtccctctgctgatcagggaaaagcgaacgctgaaaaaaactcctgagatgaaaacgagacactaataaaacactgactcctaagctgtttaccagacattcaaaatggatgtgctggtggtttcctgaaaggaaagaatagttgtctcatattctgaaccccggcaggctctcgcctctgagaaaaagcaatgtgttccagataccagtaactctccattaagcctgccatcttcctcctagcctgcaagggcctctcaacacatctgagaggaaatataaaattgaaatctacctcttacatttttttttcctggtgggaaaattggcatttccctttttaaaatacagttacgtatgatggtgacatttggggcattattcgattatatcagggagcacaggccaggcactgtggctcacgcctataattccagcattttgggaagccgagatggacagatcacttgaggtcaggagtttgagaccagcctggccaacaaggcgaaaccccatctctactaaaaataaaaaaaaaaaaaaaaaaaaaaaagattagctgggtgtggtggtacatgcctgtaatcccagctactcaggaggctgaggcaggagaattgctagaatcttggaggcagaggttgcagtgagccaagatcacgccactgcactccagcctgggcgacagagtgagactacatctcgaaaataaataaataaataaataataataataataataataataataataataataaaatgtatcagggaacacaaaactccctaaatcctgccttggcccatctaaccctcttcctccacgcacagggacaatggtgaatggacacacagaccagctatgctggtacagagcttgtgccccaaaccccactgcagagaactgtgcagtgtgtgctgggctggaacagagtatctccccaaatttaggagcctctgcatctttctaagtctaaacttgtatttcaggaccttatcaccatccattcagttgcagaaacagagagatcagaaggaatgcccaaagaggaagagctggctgttcccagcaaagcccttttaagagccagtgactccccctgcttatccatgtggcccaatcactatcctaaaaattgacctaatccaatcagtgtcccttcctcttgggaaggagacaggctaagacctcctctttcccatcaaccataaaattggcaatattcacttccgttggcccagtaattattacttactcatgcttaatacaggctagacattgttctgagtaggtaccttataagcatcattatgtttaagcccccaatagccctatactttaaatcctactattgcccctatttggtagatgggaaaacttgatgcaaaagccaatggggagcctagatttgatcccagatgatccagctccagtctgagttaattagtagactatgctgcctttcaatcaatccacttcaagtatcatgtgtcctaaggaaattacctatagaaaaaatattgacacacaacgatgttcatctcatcatttacaatagaagcaaaattaggaattaaacaatggagaagattaagtaaagtaaggtacatgaaatatacatacattaaaatgatgtgcaattacctgcattgtcagcagactaacagttgtaaacatgtagctactgctcatcaacggaaagcttatgtataatacagagagtagggttcctgtcagccttcagccagcttcctaccaccccaataacattaggagagaatcaggaggcagggtttccagcacagcctctaggagaactcactaaatagacagttatccccaaccttgacaaaaacttccaaccaggatgaaaaccattcaacactcccaactatttaatgaatattgttagcactttttatggggcaagcgttgttccaagaaatttcgtgtgtattcagggatttaatctctacctggcaggtagttcagttattatcctctcttcctatgagataggaggcatggcaacagcacacagctgagaagcgggaaagccaggattcaaaccaaagtcatctggttcccgggtctgcaacttaaccaccaccccacacagccattccagcacagcctgcggtgagagccaccttctgcctgcctgcctgtgggcatggatgtgtgtggccctgtggccagcacatttctggcttgcagagtgaggtacatgcaagattgtgagtccggagatgggattacgtagggaatgggttagtggtgggaactggggctggagattgcaaaagcaccaattccacctaccacacacccttcccacctgctcccaaaatacaagcagacctccctgaacagagacatccatagaaagaaccaagtatttgtgtgtgccttaaatggatgatactagacactattttgttctctgatgttatttttactctatagtgtgtcttacggtctgtgcatgctggaacatctatttatttttatattttgagagatgggctctcattctgtcattcaggccgaagtacagtggcactattacagctcactgtagcctccaactattagactcaggtgatcctccaaccttagcctcctgggtctgtagttagggctacagacactcaccacattgctcaggtaatcacaacttttttttgagagatggggtcttgctatgttgcccaggctggtcttgaatttctggcttcaagtgaccctccttcctcagcctcctaagttgccaggataataggtgctcgccactccacctaggtcatgttggaacatctagatcttcccacttctttgtaatggcttcagagttttccacagtaggaaaataccaacggatattgagccattccctactgatggatatgtaagttgtttccagcttcttcatattttaatccatgttgcaataaccacccttatacatgcctttttgtatgtgtgcatgtgaaaatgtttctctgccagaaacacctagatagacatagtagaggataagcatacacattttttggttttattgttagacttcaaagtagccacactaatttacatttgccccaacatggatgaaaatggttgtcctatgtcctcagtactcaatataatcaaactcaccacaatcaccaccaccaaaagattgagacaaaattatggagctactgttttaacacagatttcctacttgttatcaagatcttaccatagttttttttaaacccattttgatactgtcttttgtgtattgcctatttatattcttgcccattaaaaaaaaaaaaatcctttcccagccgggcatggcggctcacgcctgtaatcccagcactttgggaggccgaggcgggcagatcatgaggtcaggagattgagaccatcctggctaacacggtgaaacctgtctctactaaaaattcaaaaaattagccaggcgtggtgacgggcacctgtagtaccagctactcaagaggttgaggcagtagaatggcgtgaacccaggaggcagaggttgcagtgagccaagatcgtgccactgcactacagcctgggtgacagagtcagactgtgtctccaaaaaaaaaaaaaaaaaaaaaaaaaaaaaaagagttccttgtatactctgaataataattccttttatgttacattgctaatattttctcctatgggttttcttttttggttttaactttataaaaacttctgtcatgtcaagtattttaattttgatatggggaaatttctcagtttttcttttatgggttttcctcttcataggttgtttcacaaagtcttctctactcctatgtcataaagatgttttcctgtatcataggtttatcattttaaagtcaactctttaagatctacttgctattttcctcagtgcaatctggctttcacatctaatgcactagagaagttattggaagtcactttctaagtcccaaaaccaaggtttattttttttttctattttatttctttgatatatttgccagttccgtctcctccatccacccgaaaaactttcatcttatgttcaaaaaaactgtttcttgaatcagtagagggaaatgcagtttttttctagctttcttgaccgctaaatcttttctggctgcctttactcacctctcaaatacctgaatccccagagatttgtctctgagcctactttatctctccacatgtgtcctggcttcatatccatcatcaaggtttccactattagtatattaatcctctattaacaaatacttgattccccaatgcaactctttctacctcattcacatacccaacatttccagtcatcaactaaacaaatacagctgcatgtccagtgaaatccttaagaccaacttgtgcaataccaaattttttctacccttccatccttcttcccatctgttgccttcccttttcttttggaaacagtcttgctgtgtcacccaggctggagtacagtggcacaaccttggctcactgcaacctccacctcccgggtgcaagcaattctcgtgtctcagcctcctgaggagctgggattacaggtgcataccaccatggctggctaatttttgtatttttaatagagatggggttttgccatgttggccatggctggtctcgaactcctagcctcaagggggcctcccatagtgctgggattacaggcatgagccactgtgcctggcctttttctcttctttgtctttattaacctcagaaccaaaagaagtgtacataatgccttgaacgaacaatccatctaattacctggttccttttcttattttttgtgagaaacagggatcttggacacaatttccttggtttaccctttaagaacaatttcttcaatttctccatgcaggttttcaggttcaggaagcacttcctggaaaggtgactaaaaatcaattcctttttatgtcatttaaatagaaaggaatagctttactgtttattaagcagctcaaggagagcaccagatgaccttagttccatcactcaatttccgccagcatcagggttggaaaatcagttcatccccaaaaaggcaaactttcccaatggttcactctgcaacctgcagtcatcttgcttcaagcacagttagagtcagcaagcctctgaattctgaggaagaacaagaacactgttgttgtcacctgaaggccaaaaactgtttctaccaagtctaaacttgggaaggccacagagaggaattaggaagatttttccactctgggctgcccttgcttttggtgaaagggagaggaatactggctttttttgtattcttggagtatctggcagcaggatcaggcaaaaatcacaataaattttatatgtcagtacacctaggaaaaacagatcaaccaaatgcttgccttcctttaaaaatggactgttcactgcagtgagtgctggaggacaaggtagaggggacaaccagatggggacaggctggatgcatggagaggaatggacttcagggtcaagttggtaagaactaagatattattttaaccatgataatcattagtagtaattccacatattaaatatctctaatggatatcagccattatcctaactgttctcagggcatctgtttaatctccccatcgttgctggtaaacagtctttatgatccccaagatagaggaatatgaggctcagagaggttggtgagcttgcccaaatcacagagctggcaaacgagagcaccacagttcaactccaggtctgtgagatgtcatttgtgcatttttccacgactgcaagttgctttgggaagtatagaagtgaggtgtctggttgtgtggggccaagagtacagtggcctcagcatcatgtctgatgggaaggagccaggagaacactgggtcctagaagagggaagggagctggtataagatgaaatcacacattagacaccagcttagagaggtgacaaccatgtgcacagagtagaaccagagggaaccagtcagaggcagctgtaacctaagcagcgagaacccaaagagcttacagtaatggtggaagtggtggaaacagagcaagtcaagtacagcaatgtcaggggaacttcgtgaattaaattgggggctgtatctttccttacaggttttcaagagagagggctggtcataataagacagtaaaggaggcagaagagaaggaggaatgccttctgggtaagacacaatgttctagcagtaaaactagcagccttgcttctaggtagtcaattttccatcatggacaatgttcagagacttgccagctgttgttgcatcagggatgcaagtatcaacgcgaatttgatgactgcaagtctttccttaacttgagattctgttgttctaatcttgctgccctgactttaccagaaatttcacaatgacctcctaggtaagcccaaaaagccccatatcccttcaccaccaggtgggccgcacccccagccaagccccaatatgggagactcaagtctgaccaactcttagaagttgagaagtctaagaaaattcactaagcctgggtctcatcttctataagacaaggatatttatatcttccttactagatttacatttaaaatctagcacagtgcctaggataagacgaattgaatctaagtcacctatctattgactgtaaaacctcttggttgaacaattttatataatacccatttacaaaatgcccccctaaacattagtccatttgctagacactagaactatgctatcaagtatggcagccgctggccacatgtggtcatccagtaattctattgtacagcactagtctagaagatcagaagagaataagacaatgtgcatctctaaggccaaatatttggctaagggtggggggtaatataaaataactgcatgttttagaagttctctagtagaagcgtgtttaccatgggtgcacatggaaccaaatctgcgagactggggccagggcagtggcaagtctgagaaccttatgcaagtatgatgggttgtgtacctgtatgatggtagtgcaggaaacccagacaccctttgattgttcacctactgtaatgagatgcgtctgtcttgtagacacatgctctggcttcctcaacggtctgcaaaaatcgatcggaacatcaaggttcagagacatgaggaagtccaacccctgaggcaaaagcaataaacaacagatctgagactttaatcccaaactatcaagagttcttgttcttggcctatatgcggcactgctccaatttagcagtctcttaatcctcttccctaaaacctgtcaccatccctttctgtaaattctttaacaagtaatagccagctacaagtaatagccacagtagccagagtagaaacggaagtagaaagccaaaggcagctttgcacgtatacagaaaccgacctttcctataaacatttcaggttgcctgtgctatatccaagtgcagtcctatcgcttcctttaaatgctaccctggaacctttgaacacagcctttaaacatgtttggccttgagtattcatggagaaataaccatcaggccggatagatttgtttattagaattcaagactctggaaaacagcttagagcaattttaaaatagcatccagtggaataaacacaccaatggcacagggtggtcagtgaatgtgttgcaaacagccatttattaaagaaaatgaaaccctggtgacagttttaaaatcatcatcaaaacgctttttgtctaaaagcaatatttttatagcgtctatccctggctataaatgtggtgtttcttcttaaacagtcctttcagaaccccaggtccagcccaggagacaagctggtgacatcatcctgctctacaaaaaaggaattgttcagcctccaatgaaacagtgagatctgccttccccaaagacaaggtggggcaggggtcaccccaccctgttatctttgatgtgtgtgatttctttttttttttttttttgatgtgattttttttttcaggtctctgccatcccacgtgcatttcctgataagatatgagggggagagcctcacctaaatgggaaggccatgtctgatgtccgtcagcatttgtgacagggagaaaaaccttcacgtgagaatgttctgaggtccatcactatccacagaccctcatcccacttcctcttctcctagccaatcctgtcagccatttagtttatttcattttctctgctttttccctgaagagggataagctggagttggaattcctacaggaggaagacaagttaaaggacagcttctgtccctgtctggcctcagggccaagaatccacaagacaagcagagcttctccagtgccgagtgtgatgatttcttagtgtgactccaagtgctggtacaacagatgagtctcagtctctttactcttccatgggttgcgttgctgttttccttggttggccaaatgccttgttgccttagagaggcggtgggaagagaaggaagcaaaagcaaagctgttcagccacacattcaaaaataattattgagcaaatactatgtgccatgtgtcatatcacatgcatggttgaactaacctgacatagcccctgccctgcaggagtttacagaccagcatccagcaagtaaatcaattaagtaggtaagtctttaaatgagaagcaaattgtgatgaagcctatcaaggaagcagggtactttgatggagaaccacagggcaggacctttctagattatgcacattgagaaggcttctctgtggaggtagcatgtgagttcagacctgaaggacaaggtggagttggccttatacaaaacagcacacaccgagatatcaagtttgggaaggcatggagtggactgacagaaaacccatgagagaaagcacagtgggggtgtgggaagagacttagataggatttagaaatggcaaacggtctttgcaactggaacaagtcaccaggaagaaccaggtaaaagggcctcagcaatcatgataagcaatgtgggtttcattttaaatgcaatggaaaattctggagggtttcaagtaggtgagtgacaatttcattagtgatgcgtggtgcatccatttgaattggaaaggggctgagttgggatgggttaggacaagagctcttgacttggaatgggatgatgatggcaggagtgaagaacaaaggtcacgaatcaacacgtatgtgggggcacttgctgctgacaaggtcgtggggaagggtgttgagggcaaggacaggggcctcataaatgcctcccatgtttctgaattggcccattgagtgggtggagacattaactatgacaagggagactctggaggaatgagacttaagttcataggtcattagtgagagaagcagctagaattcaatatttgactatcatgggttagaaatgtctgagacattgaattctaagtgtcacatggacaactggaaatatgagactgaagggaggagctccaggttggggaggctgatgcgggagccacagacagcactctgaagccatgagaagaattaaggtcttctagggagagagtataggggaattagagcagccaaaggagagctctgaggagcaccaggcaccggaagtgaggaagaggtgaattctcaaatatttaattagaacaaaaagcaggggttaaatatcccagtgaatagttaatagctaatagtttcagtgaaactattcagtacaacactatacctttgtccaaacccacaggacgaatactaccaaaatgaaccctaatgtaacctgtggacttcagttaatactaacatcagtattcattcagcagttgtgacaaatacacaacattaattcaagatattttgtgttttgagacaaagtcttgatttgttgcccatgctggagtgtagttgtgcaaacatgggccaccacggttgaggctatggtagcctcaacttcctgggctcaagtcatcctcctacttcagcctcctaagcaagctgggaccacgagcacgtgccaccgcacccggctaattttttctgttttttgtagagataggatctcatcatattgcccagggtggtctcaaagtcctgggctcaagcagtcctcctgcctcggcctcccaaagtgctaagattataggcacgagccaccacacctggcccataacttgaaatttttttaaaaggatttaggaagatggcaaagaaaatttttgatcaattgtaagatcaggtgtaaatcattgatcttttcccctgttcaaaccaaagcacattttcacagcccaggtcttctggagttaatcaaaactggattgtaatttctactcagttccttgagatcttagtgatgttagacaaaaaccacttaacttttgaggctcaatcacctttaaaatggagataatattattacttatcccacaggcttgctgtgaagactaaaaagatggcattccataaattgtatgtaccattgtaattaatggtaaggatcttattattaaatactggacattgcgctaagtgcttcatagccattatctcatttaatctttccaacagccctgtaaaataagcattcctagcccccactgttaagatgagagaagccttatagaggtttattgacttgcctgagatcacacagctaagcggtaggttgtgaactgagctcagcctgtcttcacaatgttctcaaatgcccatgcattaactgcccatgttggtacaaagagtcaacaccggaggtcagatctttaattgtacagttactttgctgaatcatgtcagactttcctacatcagtggtcttactatggtcttactatattggtaggttacaaaatggctttaacttggaggaaatgaagatgaaatagactgtggtttttctcattaagattcagaaggaagcactcattccttgattctttctgtattgtctcaaagaaaaaacaaaggcaaaatgaacttggtccttcagaccttccaaatctgcaaccactgccctccatttgcacctggtcagccaaataagcatgtggaatgcaggaaggcctttccctgggtctaaattcctccctctcggctattcctgtaatgcaagtccattgcttttgatgcaaaagcctatcaggtcccgaaaacttgcccttaaagcctatggttaaaggtaggaataattgagtttctcattacattaattttatttttattttttatttgagaaggagtctggctccgtcgcccaggctggagtgctgtgacaaaatcccggctcactgcaacttctgccttgtgagttcaagcgattctcctgcctcagcctccagagtagctgggactacagactcctgccaccacgcccaactaatctttttgcgttttttagtagagacagggtttcctcatgttggccaggctggtctcgaactcctgacctcaagtgatccacacacctcagcgtcccaaagtgccgggattacaggcgtgagccaccacgcccggcgagtctctcactaggtttctgtgctattacatcatgcacttgaaagtgttgtttaatgtgttcaaggaaaaatgattggtgaggacctgaaaaaatagctattgatctattacattaattcttattctaatggaaataattcactttttaaaattttcttttcactgtaaggtacattttcccaagaaagtaatttgcccgggctggagggcagtgatctcgaactcctggggctcaggtgattctcacacctcaacctcccaggtagctggcattacaaatgtgtgccaccatgcctgatgaatttttttatttttttgtagagatggtgtttcgccatgttgcccgtgctcttctcgaactcctgacctcaagggatccacccacttcggcctcccactgggactacaggtgtgagccaccacatgcagccccaaggaagtaattcttgatgagtctacaaaatcctaatggaggaaagccctatattttatcatcgagtatctatttccgcaatctccataaatcccactgagaaaactacttccaagctacacttgagctgcgcagacacatgagtatgagtagacacactggcttgaatggtgctgtggcaccacacacacacacacacgcagtaactttcctttttctccaattttttttttgccctgaaaactaaattgaatccattttccagaacatttagtgaatttcagagttccaaatcaaagaatttttcacaaagaccccaatcttctcagagtttaaatttaaaaaaagaaagcaggctaaacctgtagttaagtttgacacactccaaaaaggcaaatcactaggaaatgcagcagaaattaaataaatagaaagcctaacatgaggcacaagaacaagaggccaccttatgctgtggccagcagaggcattcaaacattccgtcagcaggattccagccaacctccgaagctcacttttataagccagccccaggcatcccagagcaagatgtagctgtgtagtctccttccatagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagaggtaatggggcttctcaatcaagcaaaattctaggcttagacagtgtggggaggtgctggacaatgttaattttcaaactcctccaggagactatcttcggtgatggcaccatgccatcatccctatatggcatttcaggggattaagtgaacttgtaatgctctgggatagtttattttaaagaaaccaggctgctgggttttaaaaaaaaacaacagggaaaaaatttgatagtaaaagaattctgtgttgtatattttttgttaggtgggcttaaatagaatgtgcttcagaggaagctcaagtggatttctgaaaatctggtgttattaatatggggcaagaagaatgtattaactgagcacactgtttcactagtagatattgagtaactcaattcagttatattttaagataactataatcttattcaatgtgtagcagaggatagagattttggtaatggtgacttcctgttttgtcattagttatcattagctgtatttccatatccttggcagcataaggacaacctataccatatatttaaactttttcatgtcagagacattgaatctctccaacttaaaaaagtcaatatgcaaagtcatctagtatttgaaggcattgtgatgcaaaactgaatctcccaggaacctcaaattttgagtgacttgaattgggttaacaggttaaagaaattgaaaagaacaatgatgatagcgaggtgtttgcaatacgttgaaacctaagcaaaagaaaaaaacaagacagagggtcatgttttatcacatcctctgcatcattttcatttcaggatatttcagattatgactatttccttattttcactccattagtaacaacacacacatacacaaatttcagcaaggttacagtctatttcacatgacagatggctggtgggtaaaaaggggtcttgtgctttaaggattataaagtaccattttttcagggacatttatttacaaaatttaggtctggtgcaaggtttcttttttttttttttttctgagacagagtctcgctctgtcgcccaggctggagggcagtgacacaatcttggctcactacaagctccacctcctgggttcacgccattctcctgcctcagcctcccaagtagctaggactacaggcgcctgccaccacgctcgactaattttttgtatttttagtagagacgaggtttcgccgtgttagccaggatggtctcgatctcctgacctcgtgattcgtcagcctcggcctcccaaagtgctggaattacaggcgtgagccaccgcgcccggctagtgcaaggtttcttaagtggaatcttttttccttaagaaatactgtacttctttcggtgaaagattaaaatatttctcatgagtagatgaaacatattgctgaagatggtatcgaaaggagaggggagagagaagatactgggtgacatggtacatttctgtagccagcgtttcttcactgctggatggagtggcactcctcgtgagagtggcgatcacccagtaggaatgtgtgaagagggtctgaacatgactgagtgtgcatgtgggtgctgtgtgggtgtttctgaagtaatcgcagcttaggtcacatccaggttttccaggggcctccctccccttcctcctcccactctcttctctctccctaccttctttcccacttctttacccccttcttccccactgcctctgtcataaccacatgtgcatgcacatgcttttatttaaaaacaaaacaaaacaaaactgactaggtacacacctcttaaatgtcattcccccagtatagtttttgctactttttgccattaggtcctagaaagtagattctacagtaggtgaagcaataaacctaaaccgatcaagcaattatatccccacccatccatatacttttaaaatagtttaagtaccttgaaatataataataccagtgttaaagagatcaaaagtgaaagccatcttctctctcccaatcctcaccacaaaattatccactattaactatcaggtaatactattcccagaagttttgtgttttgttttttgtaggattgtttgttttgagacagagtctcactctgccacccaggctggagtgcagtggtgtgatctcggctcactgcaacctctacccaccaggttcaaacaattctagtacctcagcctctcaagtagctgggactacaggtgctcgccaccatgcccagctgatatttgtacatacatcttttttagtatagatggggtttcaccatgttggccaggctagtctcaaactcctgacctcaggtgatgggattgcaggcatgagccatcatacccagcctattcccagagtttttaaaatgcacaattaaaatacatatttttaacaaaataagaattggctatgcagaatgtttggctaggcaaataaatttatttcatctattaaaccttggatagttaccagtgtaagcaatactttattcattttaacagctgcataatattccattgtttggatgggtcatcacttaatctgatctctcccaatacatctctttttgattcaatagccccaagtaactgctttgcacacatactgctccccatgttaggatgttatgagacatttccagaagtaaaattgcaggttaattatactttctaattgtccctccaaatgataacaccaatccatcttcccatcttctgtgtatgggagtgcccattcctatgtattttgacagtccaacatcatataatggttttactggccatgtcttctgggaatgacttttgtgtttctacactgtgtctacctctggagagcaacagtaaaatgaaagggagccttctgggggactcaaaatagcaaccgaagaatttagcttcaaacacaagatctctctggtacttgcttcataggtctcaatttatgtgttgcattcatgaataaaatatgacttttccagctcagtagttgttccacatattccctttgtttgttgtacataaaagacatctatatcagctacaaaggatggaagctacagccaagtccctggacaatgaatttcataaccatctcccaggagcctaatatcaattcatgtgtcttcatgttaattacaatgtttacaatctcccagtagaggccacttatttaaggagaatggagcaggaagctgagagggatgggggatgacatttttagaggtgacagcttataccttggaagaaagtgttcagcagtctttgcaagcccggcccccaccagctgatgaatttgcattctgaatgcacccttacattttttctggattaaatggtcacacaggtaaaaatctttaggttatagtatttctgagctgagccatgggatgctttgagaactgatgtgtagcattaagtaaaacagaggcaggggccacccctggatattccagaagacagcttcctaacccaaatgaggaaacatctggcttatgaagcacatgtttaaggggacagtgaattagcacatgtgaattttagactgtcctgaaaaatccagtacagaacatagacttcctccatggaatccccacaaagaagcagctgggaacagttcataccaagctttaagtatcttctctgtctggggccatgtgctcgggaccaagaaggtagaggcaatcactgtgcagaagcaggtaagagggatgaaatgagaacaggcctggagctgggcaaatttaaatcccaattcttcactttactagctgggtgaccttcagcaggtgaattcagctttccgggactctttcttctgcagaatggagacaatgattgtgtctctctcaaagcactactgaaagaattgatctctgacaaacagtatgtggaagcttttaataatttttgttatgatttataattcctgcttttgaagacctcacaagctgccaatctctaagagaatccttattacacctgaaatttcaatttatccaaggcttcttgttttctgccacttacttatagccaagattggtcaaggacagctataaagatcctttagcctcatccaggaacatacaagacttaagttgctaatacctaatatagacgtatttctatatgaacctttagcacttaaccctgctagtagccaccatacctgaggcatgtgttgagtcggaacactggggacaggggacctggggacccaaatcagtcagagtatgaattctgccatgtatcttttgagacactctcattggacttgtcctcattcttcagtgggaatccaatttttctcccttcatagctatgtttgaagagcaagtgaaaacaattttgtataccataaagtgtgtattcactagacaatattatgaacacctattatgtaccaagtatcatgttaagcatcagaagaaccaagaataataagacagatgaaataaagtaaaatagagaaaagaaaatatacagaatactctataaaatatggaataaaataaaatgtgaactgagactagagaatgaagaaaaataagtttcaaagacagattagcagaagggatactaaattatagtataaccaggaaagccttctcagaagaggagatatttaagcttgctaagaatacaggaaagcgctggagcaagagtgatcctagcagaaggaacacacagggaagatgagattgagctcattctcagatgaccctgaaagtcaacaagcctagagtcacaggatgtgactggagagacagaaggagcctcatctcacagaaggaccttctagtattatgattgccatgaagctcttaagaatcttcctgtccaagttattttctttttctttttttccttccttctttccttcattcattgtttttttgtttgtttggttttttttcagacagagtttcactccctcaccaaggctggagtgcagtggaatgatctttgctcactgcaacctctgcctcccaagttgaagcagttctcatgcctcagcttcccaaatagctggaattacaggcattcaacaccatgcccagctaatttttatacttttagtagagacagggttttgctatgttggccaggctggtctcgaactcctggcctcaagtggtccacccgccttggcctccccaagtgctgggattacaggcgtgagccacttcgccagccccaagttattttcacgcattattttttgtatacactgggctcaggttcaccaaaaccactattgccttgggtcctacattccaaagcttgattttattttaatcatacgcttttcatccacctaccccatcccaccctaaaattttccccagacaaggatggagatctgaagactcaaattgaaaagctctggacagaagtcaatgccttgaaggaaattcaagccctgcagacaggtaaggtgcagaccttctcagtgccttgtcccaaaggagacaggaaaatttctgggtcaatttctgggggacgtctttttaaaagaaacattgacaaatcaataatgtggccaataagagggccccaatgccgggagatgattgttttaggaaatcagcttcatttacaatcccattctcctatatatgggtggtatagaaataaaaataagtagttcaggaataaatttgaaaagtcagtccatacttattctctaaagagtagtgaaacagaatgaagccagtatgaaatgactaaaatgattagcatttattggatgatagctaagtgcctatcaggccaccaggactctctcgggccacacccagcctaagatgctggaaggacatgggttagaaccgcagcttgccaacagggcagcgccagcgttcctccccacagttatgcagccacatgcgctactgcccaggagctattctccaaggggtgaggaagtgagccatgtgggcaggtttgggaacagccctggtttacaaggctcatcccccaaggagctaatatcctttgtagcaatttcaaaagcaaggtgttgaggttcctcacaagagacctgcctcattacaagttactgccttcagggaagactgaagttacggctttccatcaagtatttataactcccagaccagatgcatgttaccaacctggggtcatttttaccacaagcaatgttgcctagtaacaagggtgacatactccctttatcaggcttccgggggaacagaattagaaagttaaaagacagtcaaatgcttatgcagaaggtgagtttggttcatcctttacccacagtcaggtactagaaattctttataaacacaaatccattaatcctccagcaacttaagctattatgatcctaattttacagatgaggaaaatgaggcacaaagaaggtaagtaatttgttcaagagatacacagctagttaaatgtcagagatgagacctaaacccaggcactatgggctctgaggcctgactctccagtgctacggcctaaaactatctttatgctcagtttatcctgaataatctaaacaatattaccaaggctcagttatctgcttaagaaaatccctgtctctccacatgcaaaactagaatttaattgattgattgattgattgatttttgagacagagtcttgcactgttgcccgggctggagtacaatggcgcaatctcggctcactgcaacctctgcctcccaggttcgcacgattctcctgcttcagcctcctgagtagctgggattataggcacacaccaccacatccagctaattttttgtatttttagtacagacggggtttcactatgttggccagactggtcttgaactcttgaccttgtgatccacccgcttctgcctccctaagtgctgggattataagtgtgagccaccacgccaagcattttttttttaaacaaatatttttaaaaataaatattaaataccatctagttccaaaactcccaaagaaatccaacacagagtagcaagcatgtatatatcagaacagcatgaagtttaaggccatgtcttgggatagggcagacctgcatttgggtagctgtgatctcacatgctgcaaaaattacttcatttaaaaaaatgtggctaggcgcagtggctcacgcctgtaatccaagcactttgggaggccgaggcaggcggatcatgaggtcaggagatcgagaccatcctggctaacacggtgaaatcccgtctctactaaaaatacaaaaaattagccgagtgtggtggcaggcacctgtagtcccagctactcgggagcctgagacgggagaatggcgtgaatccgggaggcggagcttgcagtgagccgagatggcgccactgcactccagcctgggcgacagagcgagactccaactcaaaaaaaaaaaaaaaaaaatgctaaggtgttacaagtaacaacttctctaagcctaaatatcctgatatgtaaaaataggggtaataaaatacaacttcatggggttgtcaggattatgtaacttaatttatgtaaaatgcttagcatgttgtccggcacatagaaaattttaactgttgtctcatcattatcatacttcattccacaaatacttattgctatttgccaggtccagccctagtcataatacactcaaaatgcatcttaatatgttacacttcacatcttcacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaaaattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcatgcctaccctttttttggaagtttccagccgcaatttgaaatgaaatgacaaggtgtatatttgatcaattttcattcccaccattgcattacaacctctaacttaaatgggtaaccctaaggcatatcaaagaagcagattgcatgataaacggaaacagaaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatcaatagaaaatgtgttcgagtgttaattacagttattcaaaatatgttggtttatattaaacttggcagagtttgaggggaattaccctgaatttaatcaaactggtgattcggatatactcagagaacaattttacctggcaatgaagaggtatggtctggctagaggagggaaacttttaaaaaattttagctgcagaggctgggcgcagtggctcacacctataatcccagctttttgggaagctgaggtgggcgtatcacttgagctcaagtgttcaagaccaacctgggcaacagggcgaaaccctgtctctacacaaagtaccaaaattagccaggtgtggtaaggcatacctgtgatcccagctactcgggagactgagctgggaggatttcttgaactcaggaagctgaggctacaatgagctcagattgtgccacgacactgcagcgtggatgacagagcaagaccttgtctcaaaacagcaaaaaatgtagctgcaattatatctggttgatcttggccaactccctacttccaacgtaaccacagtcttcgtaaaggtaatgaccataatgaaacgggtggacactggtgagtaagtgcattctcttcacatttcaggtactatgctagatcttatataattatcatttatcttgaggaacaaccctgggaatttaacctggagaattaggctctagaatcatttcatattacagaagaagaaaaaaaagagagttaagttgtcctaagtcacaggccaggaaatagtggaactgtcactggaacttaacaagctgactcagatcctgtatacttactacccatggggagcaataaaaggtaaagcccattcagaaaggcaatgggagtggattctaatccagtatctcaatttccttaggtgaagtaacaatctggactaacagctgaccttgagaagcattcagtctgaggctacttcacagaaggtgtttttccttccccctttgcaagggcccaaataaagacaaagacaaccaatgttactgagcatggtggttcaagcccctaatcccaacgacatcagagactgaggcaggaggattacttgaggtcaggagttcaagaccagcctgggcaacacagcaagacatggtctctacaaaaaaaatttaaaaactagccaagtgtgatggcacatgactgtagtcccagctacttgggaggctgaggcagggggattgcttgagcccaggagtttgaggctgcaaggagccatgattgtaccacttgactccagccagggcaacagacagagtgagaccctattgaaaaaaaaaaaaaagacaacatttgaagatgatccattaaataaggcaatccttcccaaagtgcctcaagaagaccaagagagtaagttaatgcaaaggaatagatgaaggttagtgacatcaagatgagggttagcgaatatcaagatcagttagcaagacaaagcacagatgatgggaaacagcaaaactggaaggaatggattaaaagattacctggtttgttcctgggtctaactcatgacctcgactttgttacttagccaacaaagcagatgaaagccacacccacaagattccctaacctagacttctctttggtctgttttgcctgttgggtactctctagcaaacaaatggtcttcaggcaggaatgataaattgttcttaactctcacgccaacttttttttttttttttttttttttgacgcagggtcttgctttgtcacccaggctgcagtgcaatggcacaaacatggctcattgcagcctcaaccacctgggctcaaagtagcagggacgacaggtgtgtgccatcatgcccagctaatttttacttttgtagagacaggggtcttgccatgttgcccaggctggtctagaactcctggtctcaggcgatcttcctgcctcagccttccaaagctctgggattacaggcataagcccatgctcccagcctcaggccaactcttatgcttccataaaagctgtctggactagaggatagagaagcatcctgaagcctggtggaaacaatgacataaagaattagcaatgtctcccctacaaggtcatggtcagaggatgtgaacattgtatcatgtaagtgtcaggtgataaaacttcgaatataactgacatcttcaggaaggtaggcgtttcccgtcttcccaaagatgtcagttacattcgaagcccaaacagtctaggctccccaaaccttaccaggaagctgattctaatcttcagagcagtgcttctccccaaaccttaccaggaagctgattctaatcttcagagcagtgcttctccccaaaccttaccaggaagctgattctaatcttcagagcagtgcttctccccagaccttaccaggaagctgattctaatcttcagagcagtgcttctccccaaaccttaccaggaagctgattctaatcttcagagcagtgcttctcccaattttaaatgcttgcagatcacctgaggcccttgctaaaccacagatcccatggggctgggccgattccaacaagctcccagtgcacaccaaaagtctagaccacagaccacagcatgagtagcaaggttctaaagtttcagctacttgcccagacaccatctctgattaattgtagttctgctgcttgctagcacaaaagggtaagatttacagttcttctgagtaaggaacaatacagacagcaattttctacttaccaaaatgcttccatgcccgtcattaagtgagataacaagaaaaatcagtaagctaaaggaaacacctataacagactcaggctcaattagtattgtgaagaactggcttattgcaaggctcaatggcttctttctctttcccacttatctggttgattttggccaactctgtactccaacataaccatagtcttcctaaagataacgaccctaatgcaataggtagacactggtaagtaagtgcattctcctcacatttcaggtactgtgctagatcttatataactctcatttatttctgggcagcatttcttatctaaaaataaagttctattactggaggccaagaatttgaggctgcagtgcactatgcttacacccataaatagccactgcagtctagcccgggcaacatagtgaggccccatctcaaaagacagtaacaaaataaataaattaaacaaatagaaatataaaatattttcttctctcagattagcaagaacttccataacatcaccaaaaaaggcacatctaacaaatgaaacccccaaaatttagtatttggaggatgcaataaataacatcaaattttagtaagctcagtatcttatttaatctggtgcaagaaattcaaaggctatctactaacggtaataggtaatatggagagacagaaaaagtcagtcatatcacgcaagagagcaagactacctgcgggggtctgtgaagacaatattaggatctataattacacatggcattaagcagatggattactatctaatttttttctaaactgacacccacaaaatggaaaatagtttaaataaaattctgctaaggaactataaagtgaatatacaatagtcaaaaacatgtgcacacatgccagcaagcaaagctgacacttctcctctcagtgtgggtggttcagggaggtatccgcagcccacacagagccaatcagattattttccagtggttgtcacctggaaactgggagcaatggaacactttcccctggacatgttcaataaggacaaagtaaatttagggcttctggcagaattctttctttctagatgagtgcaatgtgcagaatgaagcaaaacaaagataagcagtgatgagaaataaggggacaaaaacggaaggagagggaagggaaagaaaacaacagggagaaaatgtgtgtgttctgatagttcttagtccatcatttcaatcccctaaggcccgggttctatttctgtacattctgtgagctgccccacaatgcctccaaactacagaatacaattcttccttttcatttgtgctagtttcagttggcatattagccaagataggctaggttatgatgcagtaacaatctcaaaacctgagtggcttcaaacagcaaaggttactactgtcccttcatgttcatattcttcgtgcattaaaaaggggctcttctcggcattgtgctcattctagaaaccagcggatggagaagcaactactgtcattctctacagcagaggaaaagagttttggagagactcacagcagccattaaatgatctgatacagaaatagtaaacatttccactctgagagatacctgcaagtgcagttcagccatgtgcccaggaggtagagagctcgaatacttggtggtgatcagcatgtctcccacagttgggtttctgtcacttgcaatcaaaagaattctgattaacataagccatgaagagaaatgagactagaaagacctgtattccaattgaaagagaaaatgggttcatggagataggtagatagcagtagaaacgcatctcatatttggtaaatggaagccgagttcaaagcttcaaaagctggaagtcagtttaactgtttaactgtataaattggaattattacatgcaactccaaaggcaggttcttagcatctgtgatagctttctagaagtgggacatgcatttttaaggggagatggtatgtgcaaattttatcttattaaaagccaattattccagttgtccaatatatttaatctacccaagtagagtgaccatggattacattccaatttgccctggagagtgctgatgaatgacaattgtttaaaaatttatagcaccctttttcactctgaaagtttcccagtttgggtaataaattatactgtcatcctaactataactcaggctttgtttcagaggattgatgatcttgcctattcctacattttaaaattcaccttccattcctttcatggaggagccctacacttgagacaaactatgctactcatgggaacttaaatgcaccattaatttacaccagcagcactctgatcatatttctctttcctctgtctagaactctttcttatcattgtgtttctggtgactttcttctctttatttaatattcaacacaatggtgaccttttctgccctcctgcaagacatatttcttcctctgtgcattcataataccttatataactcacagcccttattgcatttgtctaacaatggacaagtattatcatattatcctcccctaattcaaacctttcaatggctttccaagtttcttaaaaacaaaactttaatgtggcctggaaatgctgcaaggtcttgcccttcatccctctccattctctcttccctttacgtttgtactgccaccctttgtgggcaccaatctcccctgtcacaaatatttgcagagaaactcttccttcgtctgcttaaaccttgctcattcttcaaactttagctaatcaagacttcagggaaactttctctggactcccttcacagcacttaagaatgtgcttggctgcaagtaaataagacatgactaacagtggattaagcaaataggaattattactattacataacaagaagtctgaaagtgaggaattgcagcattctttgtttcagaaaatcagtaaggccaggaatgatgtttctgctattctgtgggccttttcttataatcctaagttgtcttctgcaactccagacatcacatccacattcaaggtataaagacacgtagaatagcaccaccagcctggtttgcccctcttttgaccaacatcctccaggagactgcagtttgttttgttggtcagaactctgctatatggatgccctaaccctatgaaagtctggaaaaggaaatattgttgtatattttgccaccccaaacaagattagccttaataagaatagaaagtttttaagtaacaggctcttccagaatcaaatccccttgtaaattcccatagcacaaacacctcctgtctgtttcaatttttcagatgtgatgttacatttatatttatttctcttattagactataaactccaagggctcagaactagaaaaattgttttttgattgtatttccagagaaatatgacttttggtagaggctcaatatttaactgttgatggaataaatgagttaatgcgctaacatatttcctcttttcaagggttaagtgcaagcactattctctatgccccaggttccaatcatgatgttaagtctcattaaattaatgaattaaataatttgatcaagttattttatcagagaacacaaagctttaaaagaaacttctgttttcactcaaaacaaattatttacctccatacctaaatactttgcattcttctgaagtttggtttctttattaaaaacaataacaagaaccaaaaactgcatcaaaactgtacccagaggagccaaaagctactgtattatcatgggatacgttattggtgatgaatggctaacaaatgcaggactcaacagccaatagctaaactgagatgggaagatcaaagcctctgtaaagtgagagctttctgggctctactccctgaactgaaggaaataaaccaaaacatcttcatgaaagcgattttacacattactgcctctaacttggtatcatctggctactctgttcggattaaaaaaagaaaaaaaaatcaatgaagtacttggatgagacttcaatagaacactcaacagaatatttttaaagctttgatttccaaaacggttataaacaaaagtagttggtctaatcacaataattggactctgaacaagctatggcagacattcagcaaccaattcaatgggttaaagaaccaaactagggatctcaaatacatggcacctgggcatctgtctttgtgtgtttgtgctgcagtaatagaatagcagacactgtgtaaattgtaaagagcagaaatttatcagctcacatttctggaggctggggagttcaagaccaagaagctggtatccggaaagggtcttattgttgcatcatcccatggggggaaggcaggagaataaggaagtgcatgagagagagagagagagagagcagggagctgaactcacccttttgtaatggcactaattccactcatgagggcagagctctcatggcctaatcacctcttaaagttctcaccttccatactgttacaatgaaaaccaaatttcaacaagtgttttaaagggaactaacaaactgtagcaaccccaatttcccactcctttgtccacagcagacatcctgaattcattatacagtccttgtcaggggtggaattccagcagccagcacttggtcatcaggattggcataggagaacacattcataaccccttggggttatacacaccctgaaagcctttcccaccaattcaaggtcaccagttccctaactctgacacaccatggatgctcaaaggatgagatgatttaggaattacaacaaaccttccccatctattcattgtcattcctctccatgcttctcacatgttcatcctcagtttggcagagtttggtacacctagaaaaaaggccagacaccctaaccctggcattcaaggctgtccacaatctggtcttagactatccctctagccttatttctcactgcagtctttcacttatactgtgtacagtgggtttaacagagatacccaaaattcattttctatccagaacctccaaatatcattttatttggaaatagagtctttttttagaggcaaggtcttactttgtcacccaggctggagggcagtggcacaatcacagctcactgcagcctcaacttttggggctcagctaatttttaaaatttttatataggcaagaactcactatgatgcctcaaacccctgaacccaagggatcctcccatctcaacctcccaaagtgctgggattacaggcatgaaccaccacacccaggcagaaatagggtctttgcagactgcattagtttgctaggactttcataataatgtaacacagactgggtgctttaaacagaaatatactttatcacagttctggaggctgtaagtccaagatcaaagcgtcagcagggttggttccttctaaggggctcccttctcagcttatagatggccatcttctggtgtcttcaaagtcttttctatgtgtgtctgtgttctaatctcttcttataagggcataagttatattgggttagggtctacccctgtgatctcatttcaccctaaatacctctttcaaggccctatctccaagtacagtcatggatcacttaactacagggttatattctgagaaatgtggcattaggcaatgtttttgttgtgcaaacatcatagagtgtccttacacaaacctaagtggtatagcctactacacacctaggccatgtggtgtagcctagtgctcctaagctacaaacctgtgcagtgtgttgctgtactaaatcctgcaggcaattgtaacacaatgctaagtatttgtgtatctaaacataactaaatgtaggaaaggtacaataaaaatatggtattataatcttatgcagccacagtcatatatgcggtccatcattgattgaaatgtcgttatgcagcccatgactgtacacattttgaggtacagggatcaggacttcaacataggaatttgaggggctatgacacaaatgcaatgtgttaaaatcaggtcatattggattaggatggactctaagtccaatgattgatgttcttataagaaaaggagaagagactcagatatggctctctcctggcttctggtggtcactggcgatccttgaggtgccttggcttggtgctacatcaccctagcctctgctccatcgtcatttgcctttcttctccatgtgagccaccacacccagctatagtctttttttttttttttttttttgagacggagtctcactctgtcacccaggctggagtgcagtggcgcgatcttggctcactgcaagctccgcctcccggattcacgccattctcctgcctcagcctcccaagtagctgggactacaggcgcccaccaccatgccaggctaattttttatgtttttagtagagacggggtttcaccgtgttaaccaggatgtattgtcggttatttttaagccaccctgtgtatggtgatttgttacaacagccccagggaactaatacattggcttcagttctagcaacatcacttataatagccaccatttatgtagcacctgaaacgtgcctgacactggtcctcttaggatagaggaaaaaaattatgtgctgcagcagagaatcaaaggaaagctgaaaagggaaggaacaaaagaacatccaataagtcttatgaaattttaagccctagtagactaaataataacaagtatctagtatctgacaaataatattcacttataagcctttctattcaaggttggttcatggatttcaggtagaattcatttgaaatgtcaagaaagattatggaagcaaggcagagagaaaatctaaaaagccttttgaaggatttctgttattgctcaggttaatgctcgttaaagaatcctcaatttgggagatattagttcctattataagtcattatcatgaagcttcccatttgtcaaggatgtgtgtcgtactgaagtaggatttgacacttcagctggaagccagaaggaggcttggtaccatcctcactgcagaaaattccactaataggtccagactctgtctaaagatatcactcggggtgttatccaaaggccaaactcaacccaacaaagttggtgagttgcaggagttcatcatcagtgtttggctccaggagaagtttgtttgtttgtttttgagatggaatctcgcctctgtcatccagactggatagtgcaatggcatgatcttggctcactgcaacctccaactcccaggttaaagcaattctcctgcctcagcctccggagtaactgggattacagaagtacaccaccacacccagcttattttttgtatttttagtaaagatggggtttcaccatgttggcaaactggtcttgaactcctgaccttgggatctgcccacctcagatttccaaagtgctcagattacaggcgtgagccaccgcgcccggcataaagctttaattcttgttaaataacactgggatgggttagagccagggactcaagctccaccatcatcccaaatacaagaggaataaaacacttgcttcacacacagttgggataatatgtgaaatatgaataaggttttaaattagataatgacattgggtcatcataattggtaattgtgctgtgtttatgtaaaaccttttaggaaatgcacactgagttatatagaagtaacaaaacatcatgtctgcaacttggccttaaatagttcagaaagaaaaaataattacatatatggagaaaatgataatgtaatatggtaagataccaattggagaatctgggagaaggtcattttttatattattcttgcaacttttctgtatccttgaaattatttcaaaacaatcacccaaatgaaaactttaaaacagataagcaaactaacctcattcaatctctctagcacagggtttctcaatcttggcactactgatatttaggatctgtggattctttatcaggagctggagtggattggggccatcctgtgcattgtatgaagcttagcaacctccctggcctctgaccactggatgccggtagcatgtcccaatggtgacaaccaaaaatagctccagatattgccaaatgtcatctgggatagcaaaaatcacccagccaagaactactgctctagcattttatttcctgacaagactaatgggggtaaccccagtagtagtagtaggggatgttgtgggagaagtgagctcatcttatctttatcatacatacacttccattcctgcagtttcatccacaagtatcttaccgagctaaccatgagtgagtccaaccctgtgctagattttggaggtacagatgagcaaaagtcagagaggacttgtgtcctcacaaagcttatatctagataggtaaaatatataataagcaaagaaataaataccatttctgaaaatatgacaaaatgtcaacaagaggttgacatggtaaagggacataataaattgacaggatgaaaatgacgaaagaaaaaacaaggagatgagtgataaagtgactaggggagcaacgttagacaggatatccaacatcctaagagagtcctctctccactgaaagaaacagtgggaaagattgattttataaaccaccaggtcaagagcccaagaaaggaagggacacaaaggaaagtggcttacccccaaatcacccagcaagccagggacagggcagggactgcaattttgattcctgtctcccaaaccagagcctggaacataccagccgagttcaatgtcaggaaatgtcaagggacttggagtcagaagacctagactcggcacttacaatctgatttcacataagaataaggtgttgggcccgcacttcctcatctatcagtgggaattaaaccatcactcacagaactgtgagataagatttgaagccaggggcagtggctcagccctgtaatcccagcacttatgggagctgggggcgggtggattgcttgatctgagaagtttaacaccaacctgggcaacataaccagaccctgtctctacaaaaaaatacaaaagtttgccaggcatggtggcacaggcctgtggtctcagctattcaaaaggctgaggtgggagagtcgctggagcccaggaagtcaaggctgcaatgagctgtgatcatgccactgcactagcctgagtgacagtgagaccctgtctcaaataaaataaagtcaagatttgaaaatacaatttatgaacaaagtttctagacatgacatctttaaaaaaagtgttgtttcctataaaaccaacatatcttgctacagaaaattataagtagaaaaaacatgttaggaactacccttcacctgtcttttcatttatccaattactatttattgagcacatgtatccagtactgtctaaataattctgccatcgcccataaaagttgcagagattacatcaactgtactaaaaatttatgtcctgctttattttacttataaaataagcactttttatcatttttataatgtactttccctggttccataatattccaatatacaaatccattcagcacatgcatgatttccatgttttgaatccatttatggttgaagttttatttaaacattctaaatacaaatgtttagttggctttcaatagcagaggtcaagagaaaaaaaaaacaaaagacaccaggtgtggtggctcatacctacaatcccacactttggaggccaaggtgagaggggatcacttaatcacttaaagccaagagttcaagaccagcctgggcaacattaacaagaccctgtgtctacaaaaaataaacaaataaaccagatgtggtggcccatgcctgtagtccttgctatacaagagattgaggcaggaggatcacctgagcccagggaattgaggctgaaatgagccatgattccacctctacactccagcctgggctacagaacaagaccctgtcaaaaaaaacaaaatcattatttaaataagtaaaaatgtttttcatttttctagttttgcatatcatgctgtaataagtctttataattagtttttaaaggaacatctgtgtgatttttgtgtgtggttgacttttcaactttagatttttctccgctgttagacttccagaagtgaaattatagtatcaaagaatatttaccacagactctttgtttcatggtgcgaaattgctttcgaaaagccttgtgcaaattcaactgggaatacactaaacacagacatatatgacaatggatatcagcattaaatgttaccagtaataggctgggcgtggcggctcacgcctgtaatcccagcactttgggaggccgaggtgggcggatcacaagggcaagagttcgagaccatcctggccaacatggtgaaaccccatctctactaaaagtagcggggcatggtgggctacgcctgtaatcccagctactcgggaggcttaggcaggagaatggcttgaacctgggaggtggaggttgcagtgagccgagatcgtgccactgcactccagcctgggaatagagcaagattccgtctcaaaaaaaaaaaaaaaaaaaaaaaacaaaaaaaaaagtagtggcttatgattggtaacttttttttttttttttttttttttgagacagtcttcctccgtcgctggagtgcagtggcctgatcttggctcactgcaacctccgcctcctgggttcaagcgattctcgtgcctcagcctcccgaaacatacttttaaataaagtagggagcacaacaatggagttttaaaaggtctcaagacgagccatcaaggatagactccaagggcggctagagccctcagcctggaggaagggtacctttacagcaaccccttctcaaacttgtttatgtgtttggacatttcaatggcccagataggcagcgtgtccgggcccgagggatggaatgctgccccggggagcggctacagcgcgggatcctggggagatagctcaaggcaggccagggaaggacaggccgggcaatgggcgcggagacgaaggggccggacagcggcgaggcgctggctccggtcgcggcacccggctgctgagggcagtgctgctgcttgggacgttccaggcgaccaagtaccctcggcggccctggcagggcggtgcctggggtgggcgctgggcctccaggcctgcagccacgcttggcgctgtccgctagggccaggtgctgaagtgttggccgcgagcggagctgctgcagcgctggcttccccgggccgctgcgggtggacttggacaacataaagggctgattgagcggggccactttttcgcccgcgtaaagtgtcctccagcagcacatgctcggcctcctggaaaggaaagggaagcggcctggcttccatctgctcctgggcacccaggtgaggaggaacccaagggaactcactgcccccttttagcctcgcgctccccagtgcagccgatgacaggaactcagtgacaaccgatggaatgaccgtcttgcctccctctctgtaatggggaaaaaaagccagagataccgatccagctttttgccaggaatcaaaacaactcatctgttgacttggtttcctcatctgtaaattgctggcaatatttaagaacatctagaggccggggaacagtggctcccacctataacagcagcactcagggagaccaaggcagaaggaccacttgaggtcaggaggtggaggctgcagtgagccgagatctcaccactgcactccagcctgggtgacagagcaagacccagtctcaaaaataaaaaaacaaaaacatgtagaaagtggaatattcctgtttcattaaagtttttgtgaccgtttcgtgagataatgtaggcagaaaggcattacaaagttttttgctcataagaggtacttagaaaattaaaattaccaccagctgcaaactggtttctaaaaactggagataaaaaacgccttcatcattttagaagcacttgctcaaaaatgaagtatcaggtggctctgagaagagatgataaatttcccgagtactccaagaacaatgggaagaaaattaaaatgacagtaattttccaaggtgtagatttagccagaatgagcaacctaaatcagccctatagttacccttcaaaaagtgaacactcttaatttattatttgtcttttagcatggtatcatttgaaggaaaaatagaaggccaggtaccatttaaccttttaacagtatggctttttcacttacaaaaacttacatattatgatacgtgttgattttttagaaaaattctaagtcacgctgtgtgacgacaattcaagtttatctggtgattttctttgaatatgcacctatttttatctcacaataaccatatgatgtaggtttttactctcattttagtgatgaggaaattaaggatcaaagagatttgagcttggtgatttgcttaaggctgcacaggtttgaagctgcagggccaggactggagtccagatctgcctaagaccacagacagtgctctttgggttgtgttttacctattaaaactaaccatattacctaactaatctattaacattagtaacacaagctgtcatatttatgtaagtctagagagcagattctcaaagtcaaagacaaaacatccccccagaaatcaagtaacaagcaagagtaacttgcaaaacaggttaaggttgcttatagctgtaactttcagagctttcacagtaatcaaaaacaaactgcggtcaaatgaactgcataagttattttgtcctcatactacaaatattaagtttccagcacattaagcctattccagatttttaaacatgcagccattaacaaacacaggtgattgaaaggaactgcattggatcacctgaggtcaggagtccaagaccagcctagccaacatgcagaaacctatctctactaaaaatacaaaacttagccaggtgcggtggtgggtgcctataatcccagctagttgggagggtgaggcaggagaatagcttgaacctgggaggcagaggttgcagtgagccaagattgcaccattgtactctagcctgggcaatagagcgagactctcaaaaaaaaaaaaaaaaaaaaaaggaaaaaaaactgcattaaatggttaataagtgttaccctatgggcgacataatgtgggtgaaatttttttcttatttttctacactttctacaaggagcaaacactattattattattattattattattattattattattattattatttttggcagagctagctcaagttttattttagccaaaagaaaaaaaaaagcccaattgaattgttttgtagctggaggcatgggcaaggggggtccccagatagtaaactcccctgcaggtgggcttagggctagggctgagcctcaggtgggtctcccgttcgcccagctctcctgcacagcagcctcgcttctgggctctggcgcagcctcaggacgggcaggctgggaggggctatcgcagctgttcactttggcagatgtcaggactcggacaccagcttcccatcacgggtctcaagcttcttcacaaccacggccttggtggagctggagccggcgccagaaccaaagctggagctcaggcagtagcttgtgaggcccccctaggccgagctcagaccacttacatagccactggtggtcttcgaatggatactcatgttacgcatcccagactccagccggctctcctcaccctccagcagcttcctgtaggtggctatctcgacgtccagggccagcttgaagtttatcagcccctgatacgcagctgccgtgccatgtcccgcttggccggctgtggggcagcctcccagcttggacagcttggcgttggcatccttaacggccagctccccacactgctcggcatctgcgagggtggcctccagggaagccctctggcctttgaggccctcaatctcagcctggagccggctgatgttcccgttcatctcagagatctgtcttcgaacgccacaggtcacccccgtgcttcccagccagcgcctgcagctcctcatacttgatctggtacatggtctcacagcctcagcctggctgcagttggcgatctcctcatactgcgccctgacctcagtgatgatgctgtccatgtccagggtgcggctgttgtccatggacagcaccacaaacgtgtccgatatctgggactgcagctcctggatgtcctcttcatatagctgactgaagaagttgatctcgtcagtcaggacttccaggcaagactccagctctaccttgttcatgtaagcttcatccacatccttcttgatgaggacaaattcattccccacctctgtacgcttattgatctcatcctcatacttgttcttgaagttctccaccagccccttcatgttgccaaactctgcctccagcttcagcttctcctggcccagagtctccagctgccacctaaggttattgatgtagctctcgaacatgtttgtccatgttgctccaagccatctgctgctgctgcaggaggctccacttggtctccaagcatcttgttctgctgctccaggaaccgtaccttctctatgaaggaagcaaacttgttgagagtcttgacctgctccttctcctgggtgtgcacggcctggatgttggggtccacctccaggttaagggggctcagtaggctctggttgactgtgatgatggtgatgcctcccattccactggccccagcatagcctccaccctggccaccccggaagctgctgctgcccactcgggagaagctagagaagctgatgggggcaccgggcccacttgtgtaggagaggctgctgaaggcccaggggtcagaggtggacaccttgtaggacttctgggtcaccttgatggacatagtggaggcagagtggaggtaggcaggctgaaccaagtggagattccagaaggagcagagaagctgcttcttggtccataatttttaaatcaagaaccacgttttatatatgtaactggacgtcaatgcgccaacttattttaatactttggtgcttgtcagacacatcctactgatttgagagcttagcatttcagtaatgcactatttccattaagtttcagcctaccttattaaaaaatataagagctagaatgcatccttcataaatccaaagaaagggggttggcaacagagaaaaaagttgcattaagtggaggactcatcttaacttttgcatttgccagttaaatggatctgttacccagagaccagcttgcatcccaaactacaatgcaaggagtggattatgactggatactcaacatcaggacagtagaacaaaaagtaatcttcacacgttggggaattctcaccaaaagcagaacaacttaacactttctttctcctttcagttttttcagatattttccaccaagttacttttgcctaacaattcatccaccatcacaaaagactaagagatcagtcaagagatttaagaatacatggaatgaaaatttaaaaattcaaaagactctttccctgaatccaaaaactactgcaaagaaaccggctctattcacagtcatcttcaaagaagaacattcttggcaaacattgtccttcaccctcagagagaggaaactctcttttatgtttaatgtacattcctcctgctttgaagcctccctttccctgtcccctgtggagagtttctgttgctttatggattttaaagtatgcagaatttatattatttcagcttcttaaaagcctcatttgctgagaaagtgtgcgtatcttaaaatgcatgaattctgtatggtgccagaaatgtagaaaatgtagaaagcttatgttatttttccagaggaaaagtcaaagctgatggtcaagattgatatgttagccatagcccaatgatagcaaagattgtgttggagtcataaatgtctctttacaaatgccaacggcctaggcagatattttataagctccatggatatttaatcaagcatgcctgtctttgttgacctagagcttttggtatttattagcaattttttgtgttaagaaagaatttttttaatcagatgaactttatggtggtcaaaggtcaaacaaataattaaaattaatagcagctctgaataaatgagtaaccaccaccaaaccagagagggaggttatctcaggttgacagctctctaaataaaaaagctgtctcattaggtgatgaaatttacttgcctgaactgcccataaataaaaggtttctgtggcctaccagttgttgatggggacagaataatcactcaacaccagatgcaatgcaacaaagtaattaatgctcagaactcagagctgggtatgaatcaaggatcctttacttagtagttaactagaagactgggactagttaatttctccagtgctcagcttcttatctacaggtaagaattgtcacggtacttacctttctgtgttattgggaggattgaataagaaagctcatagataccttagtcattgtatacatgtatgcaatgaagtgaatgctaacaattttttttttttttggagacagtctcactccatctcccaggctggagtgcagtggcatgatcttggctcattgcaacctctgcccgcatcccgggttcaagcaattctcctgcctcagcctcccaagtagctgggactacaggcgtctgccaccacgcccagctattttttttatttttagtagagacggggtttcaccttgttggtcaggctggtctccaactcctgacctcaggtgatcaacctgcctcagcctcccaaagtactaggattacaggcatgagccaccccccctggccaactatttttgtcctcctttgcatcatttcatatgagcacatattcccaaatgtgaagacaatgactccccctccgtttatcctccactccaggtatctgctgaatcctccaaggggaacagaataaggggaagatccctggagatcagattctcagatccagtatcccgtgtgctgacctgccatgacaaacactggcagggagcctgccatagaggaaaagagtaagaattggctgagttcacatatgggctccatcaataactagcggccaggtgagattaggtgagtgtcttctcagaaacttagtatcctccctgaaaattgtgtatacttgtactaagctcagaggattattgttgaaaattaaatggaatgagagatgtagatgtgtcaaatgcagtgttttacccaagcagatgttcagttagcactggtctccttcatggcactgagttttggggtgaccttttctgagctgtccccatccaggccctttcttttggagcgttctcagtataacccaacaggtggacacatacgcagaaggtagaaattttattcccacaaacacagcatgtgttattaacacagtaaatcatcagcgtgatcaaggcttgacattctagaaaaagaggcagcatgacagaactgctttgggcacatgtcaacatgagagcagactggcaaggtacacattagtcacaaattgtatggatggcacccacagtccctttctttcagcttcagtttccttccaaaaaaaaaaaaggaaatatctagagtattagtattcttctcgaaaacgattctaccatgctactcagaattaaccttttcttctaaaacaagtggaatagccagcaggaggggaaaagcagaaggtccttgctcagttccctctttctcatcctcctgttatttctgcccctgggatggaaagagtcctcctctctcacgtttaaagttaaaaggactttcagggtttactgagaattccttaagaggaatgaacaacctcaatgtatgaacaagaacaagaacatccatggcacttattaagtacgctttaccacattatatattttaagttctgggatagatgtgtagaacgtgcaggtttgttacataggtaaatgtgtgccttggtggtttgctgcacctgtcaaccagtcacctaggtattatgccccacatgcagctatttaacctgatgctctccttgccccaacacccaacaggccctagtgtgtcttgttcccccctccctgtcttcaccacttaatttctatgagatcaaagataagctttagtgttgtgatttcaaaattgtcggtggagacggacaatcgtaacctcagattgctgattggcagataggggaatgtatggttataagagcctgccacaaagaaaacacccaaagtgtttgctttctcttgagatggagtctcactatgtcacccaggttggagtgcagtggcgtgatcttggctcactgcaacttctgcctccctggtttaatcgattctcctgcctcagcctcccgagtagctggcattacaggtgcccaccatcacattcagctaattttttttatttttagtagagatgggaggttcaccctgttgaccagctggtctctaactcctgacctcaggtgatctgcccgtcttggcctcccaaagtggtgggattacagccgtgaaccaccacacctggcctgctttctatttacgcctcagaaggactgtaggcccattgaggttacagattacttttattttttgtatgccccacagatctcacacatagcctagtataatacattatataaatatttgcagatgggtcaaaacaactattttaagacaaggaaaaagatctcagcataatgcccccctctcagatgagcagagaagatgaattaccaaggtgtcatccaatagctagatgcatggtcttacgatggatccggatgtttttccccccactcagacgtgtatttaataattgtagaaatccaaaagaatcggcatctaatcttgaagtcgtgaatgaacctgtgggttggcttgactaggctcagccactgagctgcctcagctaaccaaggaacaggatgtgacgactatgctatcttccgtatgtcttaatcttacatatttagtttcagtaaagcatttgtaccaacggctctggagcttggaggaagactaaagtgtagtgattctgagcagggtgtgggcctatgcagcagagctatccttgagggagaagattaacaaagtcctttcttccagtatcaggagagtcatgagtggcagtcctatccaaatgggccactagggctaaaaggctagaccctgccctcttcatctctgagctataacaggttctttctccctccaggcagaggcaaggagcttgcaatggggagttttcaggaatgaggaccatgacatagttgtttctgatccctccatccagttgtgaaaagatgaagcaaaggaggcaagaaaaatgcttaatctagcagacaagagaatggacagtgtcgtccttatcagtactagtcctggtggatgcaccactattcagctccacaatgctgcttttttcccttcatttcctctgtttccattcattcccctcagttgtgatctggaatcaattctaaacctcagtgtattatgcagctgatccttaaaaacctgcaaaagcaggttacttttgaggtacttagtcacaccatgtacaaatagagctgttatagacaatgtagctttgcagagatctgcccctttgctcactagcaattagggagttaatgctctaaaattgaggcaaggagcctagagtgttgccactttacggaaggcacaaaagttgcagcaggactctatgggagctgcccaagacctgatggcatgagatttctatctgagtcattaatctgtctgccatgaatgattctatactttggctgagacatagttctggtgagagttttattctctcaggacattataaaggaggcaacgtaatgtaaaggaagaacaaataacagagtggaaatccagttttgcctcagactagctgggagaccacaggcaagtcatggaaggcctcagtttctctgactgcaattattatattggattggatggtcatgaagtccctttcatagccagacattttgtatggccactaaaatgcttaaatttctgaggtcctgaaagaaaataggtacatccctccccatccccaccactatttaggctagttttgctgagttttccccaggtcccccgataacacttcctcctaggctgggcacggtagctcatgcctgtgatcccagtattttgggaggccgaggcaggcagatcaccagaggtcaggagtttgagaccagcgtgggcaacatagggagaccctgtctctacaaaaaatttaaaaattagctgggtgtggtggcacatgcctgtggtcccagttaccagggaggctgaggtaggaggatcacttgagcccagaaggtcaaggatgcagtaagctttgattttgccactgcactccagccttggtgacagagaacctttctcaaaaaaaaagtacacgcgtagtgacagctgaccttttagtagaaatggcccatgcctttacacaactttgtatagctagaaaaggctgttttttctctccccatgcccaagcttattccattaggcatgcaggtaactgtcgtcccgacaccccgatgaccatttctcctcattccaaaacaggtaaccctaagaaataattcctacaaggagaaggtctcaaatgccaatcagcagtcatttggtgatggtgggtaaggtctaatgctacaaaaaggttgcatccagaagaattcaattccctaagaatccaaactcccaggctggcaggcagcagtgctgaggacaagctcactgttgagagtcggtctggaagaccccactggaagatcttgtggtgacgtagaccttgcaactgcattgtcatagatggcattcacactggcgcagagaggctgcagctctctcacccatgagcaaccagcccactggccacacaagacagtagcagtagcttcagcagagacaggacattgagtcccgggtggtggcttgtgggagcaggagtgggacttggatttcgggccctggtttgtttccttcttgagtttcttctcctgatccacttaactgctttgaaggtatccttctttccccctcctgaggttccttagctcgctgcttggcctcaggtttctctgcctctcctacttctgatgcctctcctgcttctaacccacctgcacggccttcacatcttgtgacgcctcgtatgcgtgctgcttacattgcctcttatccaagcaatcacttgccaccttggccaggagaggatccagggagttatcctacaggtccagacacttcaggttcttgagctaagcaaagcagacaggcagggtggccagcttgctgaggagaaccaggtgctagatgttgaccaaatggctcaagtctgtgggcaaccgttacagcccatttttttcttcctctctgtgccctgcccccaagacagggtctgtcatccaggcttgagtacagtggcacaatcagggctcactgcagccttgacctcctaggctcaagccatcctcccgcttagcctcccaagtagctgggaccacaggtacacaccacgcccagccattttttttttttttttttttttttggtagagacagggtctcactgttgcccaggctgtctccaactcctggcctcaagcgatcctcccacctcctgcagctcattcttaatctagcctcaccaggcatgtaaggccatggaaattcaacagtagagccccagatttatttcagaacagatccagcatgggggcctttggaagggcagccagctccttaagggccttcattcaggttgtccaggctcaggtccagttcattgtctcctgcctgtcagaggctcccgcccttgctaacagcctttggtcatgatgacagtggctgagagggcttggctccaaggttcccaggcatgagggagaggagctgaaatgcccttgtcagttctgtggatcccacccaacccacaactcctgcgccttccaccgagccccaggccttgcttccactagtgccgcgacgacgacctggatcaggatttttcatttttccatccacgcgtagcaacagagtcccctgactgatgttaggtatcaacccaggaccacttaaaatcaggaagaaatcaagaagtggagatatgagtgaaaaaagggaggtttttatactaattctctattttgtggaattataatacaaagcccatcagggaagcttgcactctcatccataaggcacacacataggcacatacacaaactacttcacacagttttaggggcattgtaaactccagtttataatcccctatttttatccatttaagctctcggtctaaatcttgtagccgtaacagacgttcctcagcccattatggacttctggtaaaacaggtgcaaattgttcaattacattgattttggagactcagctgtgtccttctaaggagatccaaactcccaaagtaccaagatttgtatgcttgccatgctgctgtcttattattttgagacagagtctcactttgtcacacactgcagccttgatcatccaggctcaaggatcctcccacctaggcctccagagtagctgggaccacaggtgtacaccacacctgcctaaatttttatttatagaggtgaggtcttgctatattgcccaggctagcctctaattcctagcctcaagtgatccctcctgcctcagcctcccaaagtgctgggattataggtgtgagccactatgcctaccagagggtatttcctattccattttattcatccactccattctaagatggaaggttgagtagtagctcattaatgaccagtcagttctgcctctggaaagctgtttacagagagctctcagccaggtggcttccaggatttatggccaaggtgaccttcccacccgactgcacaatggcaccttgacaggctgaatcgtcagcttagcaagtgtgagggactatgacttctctaatcaatttgtgtaatgcagtgaacatgccttggcactaacccagaagtgctccatctttggacaaacattgatcatttcaaatgaaatcgatcaaagaatccattatcctctcttctagaaacccatctgtcatctcacacacattaggcgataaccagagttgtccaaacagagatggcatatacattagccactctcaagccggacaaaagagagccaaacctttcattgcaaaacatttacttagctcacccactgtatctgaaatatctttttgaagtgtcacgttttcagcctcacaagctgtctagaaaccacagacatttacatagcccaaagaaaacgacggttgtcagtctggcttccacatttgtcttgacaaaagtccttgagacaactgtctttgggagtctccatcaccttaaacatgagcactatagactagattttctttggtctccagagagccccctacatagctaaagcctgtagaccatcaacataaaatcaaccgaatatgggattttgagtttaatccttttacaagagagcttccctatatcggtttagcctttgcatatcctctctttcatttgggtcccactgggggtcggttcctggtaactgggtccttacatactcttaggggttttggtaatcagccggtgcacgttcctctagacacttagttgctgcttggagcactctctgcatttcacctgtgttaaagaggaacatgagcaactggtggcaatcagcccaagtggggttatgggtctggataatagtttggagcaaatcagttagagcttgtggcttttcagtataggacggggtattgttttgccagttgagaaggtcggcagaggtgaagggctggtacacaaaaacacgcctctccaccatgtgaccatcctcatctatcccagtataccgctgctctctcaggggcatttgtatcccagttttgggtcttaaacgagctgccaagggaggggtttctccagaggtttcacctcctctcttgtctactctgggtggcctagggatatgtttgtcttgcggaggtgcaagcactgtgggctcaaaagtgaggagcctctctccctgataaggggagggcacgactgggatcactggtgccatctcctgcaatggatcttctgatgctgggtcgaacagaacttcaggagttgatttccctcggtgggagaaaggggatctttccttggctatctgtccctttgctactaccactgctgctgcctgccctcttaaccactgtggggggtctagcaccagctgcaaccaagtgtctatgtatgggaactggtctaagtgtcttgacttaccagttaccttgtgccataccttagaaacaagggacctgtccaggcttccttctgatggccaacccacttctaatgttggccaatctatttcatacaaagttctaagtttccctggtgtcatagtaaccccatagtctccattaaatcccttcttaaaatttttctacatagttcctagcggagtaggcttactttgtgtctgacccatgtttcctcgagacaaaacaccaagctcacaccacacgcacaccacagaacaaagaacgggtaaaaagggcacacacacactttttcagtttacaccaaaccaaaatcaaaaccaaaatcagagtatccagaaatccaagccaggtcaaaaccaaaaccaaagtatcaagcaattcaagtcaagtcaaaaacaaaaaccaaagtgccggtacaggcacgccgtgggtgatcaggccacgcttccactcaaatggagtgggcaagttccaaagaccgttcttaccaagtttcagatgtccggactccaagtgcccgttccttcccggtgttcagccactgcgttgatcctccacgggggcctgccacgcactgctctgacgaggtgttccacccgggcaattgcctaccccggagcgctctcaggatccacgtcgctcaagctggccggagtcccccacagggatgctccacagggtatgcctaagccgcctaaggggctgcctcaaccgaccgttaatcacctcgcttcccggtcaaggaaccaagaaatgtagcaggatgagtcgcagacaaaactcctcagacaccggattaaagaaggaagaggtttatcatttggccgggatcgtccgcagactcgcgtcttaagagcagagctcctcaaaaaagaaatcactggcctttttaaatgcttacaactttaaggggtccatgtgaaagggtcatgatacatcaagcaagcgtgggaaacgtgactgggggctacatacatcagctaacagaacaaagagttttacagtgctttctcatacgatgtctggaatttacagataacaccagtagttttggtcaggggttaatattattttaaccaccagggccaggtggtggcgccaaggtcacctagctatttatcttacttctgtttctttccaactttttgctttctcccttttctcctggtcttataaactagggaaaaggggaggctgtggagaagctgggaaggacaacaggagaagtagtggtctcattccatacaacctctgcctcccaggttcaagcaattctcccgcttcagcctcctgagtagctggaattacaagcacctgccaccacgcccggctaatttttgtatttttagtagagacagggtttcaaccatcttggccaggctggtcttgaaactcctgaccttgtgatccacctgccacaacctcccaaaatactgggattacaggcatgagccactgtgcccggccagcttttccttttaaaatcctgaaatcagaaagggtctgattatattccatttcttaagcagtagaggctatctccttccaagagggagttgcagggctaaagcaaacatagataatatgcaagcaaataattgtggctcagttccaaaagctttactaaaacagggagcaggcagatttgacctacggaccatggatcgccaaccttgggtctacatggaagcccagatgactgcctttgtttcattctgtttattattgagggagatctggggcttttcctcacttgtatttaacgatccatactgcacgtcaatgtactgctcagttaaaattctaggtatttcggggattctatttttctccctctgctcttatatatatgcttgctctattgcatggtttattcatagacaagaaaacttttcttagtcactgaccatttgggtttattagtaaagcagttctaatatgacaacatagttgtttttttgataattttgagagagtttcgctcttgttgcccaggctggagtacaatgctgtgatctctgctcactgcaacctctgcctcccaggttcaagcaattctcctgcctcagccttccgagtagctgggattacaggcatgtgccaccacgctctggtctcagcctcagctgagaaaaaaagcacagaggtttttttttttttttatcaaaaactactcagcagtaggccgggtgtgatggcttatgcctataatcccagcactttgggaggccaaggcaggcggatcacctgaggttgggagtttgagaccagcttgtccaacatggagaaaccccgcctctactaaaaataccaaattagccaggcatggtggcaaatgcctgtaatcccagctactaaggagggtgaggcaggagaatcacttgaacctgggaggcggaggttgcggtgagccgagatcctgccattgcactccagcctggggccatttggtatatgctcgattgcagctgaagagtaaattggaaggagaactagttcttggtctcagaaactctcacctcttgtactaggcctgccacaaatttgctgaatggaaacgtcaacatctttctggatgttttctcatctctcaaataggcaaacaggactagatctgatgttcttgaacacctcagtcttggcaatctattttaagcagactctcctaggccctcccatgttacccatcatctgagagcaatgtttctcaaacattttttttccattacccccctaaggagctttttaacatttttttctgattgcaaccctcctctttttgtgatcttcagtttcccctgtggtagtttcttacataacagtaagattctatactattatgtaactgtcatgttttataagaatattgaaactagaaaattgagaatcaaacttgggttgaaatgccaaaaaaaacccaagtaaaatggcacattccatattttcaaatttgcccaaccctatcacacaaaggcagctaagcgtggtttctgcccgtgaaggcctacagcctcataaggcttccacagttcaaagaagtcccttatgtattgtggattaggagaaatacatacatgacagaaaatgctaactccaataacattttctcattctttcatccaaaaaacaatcctctatgatgttgaaggagttgtaatagaaacaaaagtatatttaagaataactagaccaattccaggtaatatatgtatctatttcactctgaaagtcacatgactccgcactcaagtgtggaccatgcacagtaacttccttttaaaagctacagcatatgttaaagaaaaaaaattcttgacacttgttaaagaacaggaaagcagactttatataggaccattgcagtaggtatagaaaccacagcaatggggttttgcaatgaaggttgagctcaactcctaatacaagaagaaaaaaagtggggatttatagctaaggatctatcccttgactccttgagggtgagggaatcagaggatgagaaattactaacagaaaatatctagggtcagctgggcacagtggctgatgcctgtaatcccagcacttcgggaggcagaggtgagtggcttacttgaagtcaggagctcaagaccagcctggccaacatggtgaaaccctgtctctactaaaaatacaaaggttagcctggcgtggtgtcaaacacctgtaatcccagttacttgagaagctgaggcacgagacttgcatgaacccaggaagtggaggttgcaatgagccgagatcacaccactgcactgcagcatgggcaacagagcgagacttcatctcaaaaaaaaaagaaaaaaaagggggaaaaaaccattcagggtaagagtattctgcataaacctaacagaattcttgctgcaagcagatcagaataggtatcacctggggatagcggaggagcaaagaccagatcagatttccaggatgggggattctggcaaactgacatagcaggattcctgcccaaattggacaatgcagaggtgaaaatggaagcccaaaagtcaaaaaattcgttctaagtattctttcaaacaatcctctatgatgttgtttgatgtaggtggaaaaggtttagagaagcccggttaaagcttggtcaaagaaagaacctttgtcaacagacaaaggaaaaaaaaaggtaactccacagtggagaatcttggttcactacagcctcaacctcccaggttcaagcaatcatcccacatcaacttcctaggtagctgagactatcagcatgcaccaccaggcccagctaatttaaaatttgtatttctaactagctgcccaggtgatgcaaatcctgctggttcataaccacactgaatagaatctaagtacacttcctgaagaaaaacagtatcataggaaccatttcaagtaagtcttctgctccgatcttccatggccagacattgggaacaagcttgctgacttttctggagttctcctggaatatccccttctcccctaacattgctactaggtaatttcgtactgctcagtatttcagtgtagctggcacagtttaagtttgggcagtttttaaccttcaggaaagaaaagtagagaagagaggtaagataaaccctgcattgtctacctattactaggtttgtgaaatgtttgttcttgattgttctaatgatctttggaggtgactatttctattctacaacttaggaaattttggcgagttttttattccttccaagctaaaggtgaacctgcagacaaagggagtgggaagacagattcaagttttcccacttacaaccaaccaaaaaataagtcaaagaagcaaagaaaacagcaagtattttccactctcctcaattccctttgcccttattgagcctactgcaaatttgcatttgttttctgcagcagaacttcttgtagctgtttgtagttagctagttcgtagttttacattatcactttccttctaagtattctttctaaacactcaagttagtattctcaggaacaatcttaaaggaaaacacatctcctatctgtggcacatcccccttaatgtacccttgatcccctcttttttaattcaaagttgtatgaaacaagcccctttgaattaccctttatataccctaggccttgtgggcggggaaaaggttgtcctttagccccagcagacttcagttaagcatctcaaggtaaaaatcatttttcaatgtatcagaaccctcccttggagactgattcattcagagtggggtggagcctagaatctagaatccgctccatcgccccacctccatgagctttggggccccagcaatttggaagtcattttttttcccttttgatagaaacagaggtctcattatgttgcccaggttgggctcaaactcctgggtgcgagcaattcccatactttgacctccccaagtgctgagattacaggcatgagccacctcacccagccttctttttttctttaatcaaactgttcagttagttatgttacaggttgagcatccctacatccaaaatgctccaaactctaaaactttttgagtgccagcacgatgccataagtgaaaaattccataggtgacctcctatgatggatcgtatgtgtgtcatgcacaaaattatttaaaatattctataaaattagcttcaggctatgtgtataaagtatatatgagacctaaatatatttcatgtttagacttgggtcccatccccgcaatatctcattatatatatgcaaatattccaaaataaaaaaaaaatctgaaacccttctagtcccaagcatttccaattagaaatactccacctgtacctctttaactgtgggcatattagaacagggcaccttgttcatctccacatcttctatccaacccttctcaaatggtattagtgagagaataaacccctataccccttataagagttagagaaagaggaaagaaacacgaaaagcggcttaacagttaaaaacaggtttattctccaagataaacagggcttctgtccaattttggtcaggaacattcccttttacagactaaggatatttaagggtttaggaagtggggagcttatcgtaggttcagaatgtttctatgtgagggaaagtttattacagcgttggaatgtcactggtcagaggggaggctgtcttggggttggcatatttctggttggaggagggtttatcttagggctggaatgtttctggttatgctgacattagccattaggctgatgttttggggctagatttaggcttttttttttttttttagtcaagagaaacttaaaatggcagagtttgtccaaaatggcgacgcccctgctctgtcaatccagtccctatagttataaaaaggatgagggatagtgtgttctttctggctagttcctgctgaggagggcatgaagagttctttggttttggagagtaaacctgtctttgactgttaagtcacttttcatgtttctctcctcttactttaactcttacatcccaaagtatgaaatgaattaacttcttctctatgtatctaaggtatcatcactgtgccatctttgggaagaatgagaaaatagccactgcaataattttctggagggctattttttcctatgggacactgatggaggaagaccacagcccattgactagaaaaaggcctggaatggagttcacgccctcagagctcgtgcaggagccatctatgaactacaagcacattgactccgtatcctcacatgagccctgggaggcagccactgttaatatcctcattttatggatgaggaaactgttgccctgttaaagcttaatcagctttattatttgcttcccatcactgctgtcacaacttgccacaaactcactgatgtcacacaacacaaagttattatcttatggtttgggaggtcagatgtccaaagttggtctccttgggctaaaatcaaggtgtcagtgaggttggttccttctgaaattctgaggggagaatttgtttccttgcctttttattttgtttttgtttttgagacagagtctcactctgtcacccaggctggggtgcagtggcgccatcttggctcactgtaacctccacctcctgggttcaagagattgtcatgcctcagcctcccaagtagctgggattacaggtgcatgccaccacacccagctaatttttatatttttagtatagacagggtttcaccatgttggccaggctcgactcaaactcctgatctcaggtgacccccaacctcagcctccaaagtgctgggattacaagcctgagccactgtgcctggccttccttgcctttttcagctcctagaggccacccgaatcgtttagctaataatcccttccttgatgatacactccaacttcttgtttttctttatttctaaaaagcggttctgtaactctcaatccagagatgttaaaaatgtttctaggcacggtattagtaaatcaagtaaatttcatgtcctcttaaaggacaaacttccagagatttgaatataaatttttatatgtgttattgattgtcgtgtaacaaatggcccccacaaattagtagcttaaaatagcatttatgatgtcactgttttctttgccttttcattaatgttctgtacagacctatgtaaacaacttttgtatatgcatataggatagcttttttgagggtatacagctgtatacaaaagcagctgatattagttaagcttgtgtcaactactttttttgacttgtacatttggtactttttctggagggtgttgattaaagttgtatgtgcttagtatatgagaaaaaaactgcttctggctctgggcctctcacaaggtggcaataaaggtgttggcaagggctttagtcatctcaaggcttaactggagcccttgtgtacatgaatgtgcagagtgtgactcagtttccaagctcactcatgtggctcttggcagaagacataagttctttgtgacatgggcctctctgtaggacagcttacagtgtgacacctggcttttttcagagtaactgagcaaaaagccagagaggcagagcccccaagattgaagccacggacttttttttgagacagaattttgctcttatagcccaggcttgagtgcagtggcgtggtctcagctcactgcaacctccacctcctgggtgcaagcaattctcctgcctcagcctcccgagtagctgccacagactttttatgacctaatcttggatgtactatcccatttcttctccatgttcttcacataagaatgtcagtccagcccacatgcaagaagaggggatttcaagggcatgaataccagggggtagggtcactggaggccacattggaggctgtcatttataccctttgagaattaagtcagggatgtccttaatgaacatgcagcattgctaagattccagactaaatggctcaaatacatattggattattcttctgagcttactgtttatttagccaaaagttattaagaataaagtatactggggggaagaaaaggaaggaaggaaattatctttaattctcccacactaacatacatcttaatttttgtctttagttcttattcaaatatataaatatttttacatgattataattttttatagtctttggtgcccattttttaacacttggcatcatattacaaagcatcaaccacatttccagacaatcctcatgatcattttattttatttttattgggatggagtctcactctgtcacccaggctggagtgcaatctcattgcaacctccgcctcctggattcaaatgattctcctgcctcagcctcataagtagctgggattacaggaatgcactaccagcatggctggctaatttttgtatttttttagtagagatggggtttcgccatgttggccaagctggtctggagctcctgaccttaagtgatctgcctgtcctcagcctcccaaagtgctgggattacaggcttgagccaccatgcccagcagcaccatcattttaacatactagagatcttcattatcgtaaaattacttgttctcttaaagtaaggccttacaccctactaaaatgtgatcaaaattttattatgaatagatgaaaagctgtagctataaattatgagagtaagtttattttatatttatccaaatgtagttcataatagcaacttcactaaatcttagaataaaaaatgaataaaatgttaattttttggaggaaatggttaattttttctacaaaattgtgtgacagctttacagaccttactcttcacaattgacttgaacattaacatcacaaagagggtcctgttgacaaaagaatagtcaagaacttcatgaatttttgacagtgactcttttctaaccctttaatccaaatatatttaagtgtccatcgtcgtcctttatccaactcatttgttaactagttttcttctgtgagttcctttgcctataattgaagcagttctctgaaatcacccaaactgattttatgaaagcccatgcttttggaaagatttgcacttcggctttgcaatctatttacattgactgtacttgcattgtattgctagatgttgactatcagttaggacaatcaaaaatatattgataatgggcagggataaatcagaagttactgtcaataacaaagttatgttttatgggtattttataggtgataaattcattactgagcaatttcatatcatgttttaattctcctggttgtaatatggtgactctggagactcaaatattaaatattggtgtaaagacaacctcttgtcattcaatcttgtctacagtttgaacacaggaagagtctttttacatgtataatgatagtcccaatagtaataatgacaatggttactttctgcttagtgttctattctgtgccaagcattggataatattgatgaaaaggttaactattgtaatgtagtgtaagggcttaggtattaaaatgaatacaatgaatcaatacatagtgcaggaaaaggtatttgggaaaatagacataatgtagttggacaacttagcttcaaaatgcattaaacatttttatttttcctttctcttggatttcaagatataagcttgaggcaaactgcagaagcctttccttatcttttttttttttttttttttgagacggagtatcgctcatcgcccaggctggagggcagtggcatgatcttggctcactgcaagctccgcctcccagaagtcacgccattctcctgcctcatcctcccgactagctgggactacaggcgcccgccaccacgcccggctaattttttgtatttttagtagagagggggattcactgtgttacccaggatgatttcgatctcctgacctcgtgatccgcccgcctcggcctcccaaagtgctgggattacaggcgtgagtcaccgcgcccagcctttccttatccttgaaatagactccacggacctcccattctcactctcttcacatttatctaactgtatgctagtatctaattatgtgtcttcttagaagttctaggagctaatcttgaaacagaccaagcctggagacccagttgcacagttccagagatggcttcaaggtggcgaattaacaacccggccattgttgagatgacgtcagcctgatgtccaggtggactgggacccaaggtggccaccagaacaagacacgaggacattgtactcagcccaattcttgcatgccttccttatcaagttttccctttttaaaacccatgccttcccactcaaccacaactgaagcagttactttggataggagtccagctgcttccccttcaatagttttggttaataaagtcactttctttctaccagagcttgctcttgttaattgaactctgcaaatggcgagcacctggacctgcattctgctacaataatatggaggagacttccgttagataaaaattataggagaccattgttttggactaagctcctgcacaaggccccaacggaactgattaaaaatcaaaatggagtcacgcatgttaaagtttcgtgtcaccaaacctaaactaagtttttgtctgacctttctagaaatcaggagaaggaaaaatagccaattgcccaaacaggcccgtttaaatctttaatttttctattgttctgtcttcttgtacgtggttttcaagaaaaagtaactttgaaaagtaatgaatgcactctgtacacactctgttcttggtttctgttttctgcaccgttactgtgtcttacaaggccagcctcctctgcttggctcactggaacactaattctgttttatggaacgaactattgccctatcctagaatcatcaagtcagttgagatctttaaatttgttgtaattttggtttttgacaattcaagttgtttaaatctcgagaaaagaagattaagatgaacgaagaatacagttcaaaatcatccaacaacagcagagggttcaactgagataaactgccttgtatagggggcccatcctcatcttcctactatatgaatgaaaagtccatctacgccaggggcagtgactcactactgtaatcctagcactttgggaggccgaggtgggcagatcacttcaggtcaggagttcgagaccagcccggccaacatgatgaagccctgtctctactaaaaatacaaaaattagccagacatggtggtgcattcctgtaatctcagctacttggtagcctgaggcagaagataccgcttgaacctgataggcggaggttgcagtgagcccagatcacaccactgcactccagcctgggcaacaaagtgagactttgttttaaaaaaaaaaaagagaagaaaattgtccacctgcaaatgaggcagcagaactaccgatggagcaatacatggtcttgttagctttgcctgaggagccaagagggatttgggctggggggagatttattcaagaaaaaatgaggaagtcattgctgtaattaaaactggttgcagccaggcatggtggttcacacatgtaatcccagtaacttgggaggattgcttgaggcccagagttccagaccagcctggaactccagaccctgtctctaaaaaaaaaattaattaggtgggcatggtggttcgtgcctgtaatcccagttactccagaaatggaaggatcacttaagttccagaagtcgaggctgcagagagctgtagctgtgattatgccactgcactccagcactccaaactggatgacggagccaaacctggtctcttaaaaatacaaaacaagacaaaaaaacaaaagctggttgcatcaagcttcccaggaagctaatttagactcattgtcttcgcagatgcaggcaaggtaaataagcaaggcaaggcattttcaagaatagtttttctcggccggacgcagtggctcatgcctgtaatcccagcactttgggaggtcgaggtgggtggatcacctgaggtcaggaagtcgagaccagcctgactaacgtggtgaaatcccgtctctacaaaaatacaaaacattagctgggcatggtggcgggcacctctaaccccagctacttgggaggctgtggcaggataattgcttgaacctgggaggcggaggttgcagtgagcccggatcgtgacattgcactccagcctgggcaacaagagcaaaaccctgtctcaaaataggataaaataaaatagtttttctcaccagttctacctagagtcagagccgcatagaaggaaccctagaactgggaactgggacaaggcagtcattttcttgccctgtgggttttgatgaatagacctgttttgctggcagttgtggccatttgctgccttgattgcttttgtggcctttggtgccccaggtagtgcaaagcctacctgaaggagttaggagaagtagaatgaatatcacccccaggaaaccgcggtgtactttacatatgcaatttaaattaccctacttagcaggtggtagtattctacacctgaagacactaaggcggtgaaaggttaaattgcctacagccatgctgctgattaaatgttgactcagggatataacccaggtaggctaaccttgaaagcagtgcttcgtgaaaaaggctgaactgtctactgctaactgtgactcagggacacccgttaagataagttgggaaagttgccctttccactaagcatatatatgtttttttttttttaaaagtcacattgaaacagcaggagttataggaaaataaaaacaaattattgcaaagtaatttttttcaaccaaaatgaatccacatttctctttttatgccggaataactcactcggtctctctctaaatctctctctctctctctctctctctctctctctctctttgcgtgtgtgtttgcgtgtgtgtgtatgtttaacagggatcatcaaagcagttgagttcccctctgcactggtcattgatccgccagttcaaggagggatgcctgagttaacaccattatagctgaagtggggacatccattgccctgtgcttctcaaataagtgattctcagaaaccagataaaggaaaaataaaaactggaaaagcagaccacttgaaatgtgtgtgagaataaagtgaagaaccattcactcattcattcatgtgttcttgcagcaaacaacaggacatcagtgagtagggccttcctgaaccacctgctctaaaaagcctctccaaggataattaccagaggctaagaagaggactcgggggctaggatgaaggtggtgatggttaatgggtatgaaaaaaaaataaaacaaataagactgaccatttgatagcacaacaaggcaatgatagtcaatagtaactgtacattttaaaacaactcaaagaatttaactggcttgtgtgtaactcaaaggataaatgcttgagcgaatggatactccattgtctatgatgcacttatttcacactgcatgcctgtaccaaaacatctcataaatacatacacctactatgtacccatgaaaattaaaaatagaaaaagaggtcataaataaaaccactgctttggataattaaaaaaaataaagtcctcaggttgttctccacctctgaaccctgttcatttcttcatagcacatttcacaatctggtgatgtgtttgtctatctgatgaattatctgtctacttctctgggctgcaaactccaaaatcatagggattgtgtatgtttggttcagtgtccatttttaggactgaacagtgtctggaacttcataagcatggtactcagctaatactagctgatgagtaaatgagaaaggcagtggatggcctctgaagacagagaggtgaaaacctttttcctgcatgttgtgattctctaatgagattctctaatgtgattctctaattcggatgttgctaggatctagcagcctattatttcaaggaagattcttactaaggagatgcttaatttaaaaatctttatttccccctggtgagcagtctaccattcaggacttcagggctagggcaagctggctttggcctactacttggggacctgtctgagataaatatgtctcagattcttggctagaggtggtaggaaaggaggtaggatttggattgagtgtccaagactttctgggaatttggggtcagactcacagggacaaattggtgtataaaaaggcagagtttctggaatgggcttcagcaggtcttgagtgaggtccccaaaattgcactgtttttttaagagagagtattcactctcttgtctaggctggagtgcagtggtataatcatagctaactgcagcctcgaactcctgggctcatgccatccccctgcctcagtctcccaagtagctaggactataggcacatgctaccacacccagctaattgtcttgtttttaaagtagagacaaggtctcactttgttgcctaggctggtcttgaactcctggcctcaaatgatcttcccatcctggccccccaaagtgctgggattacaggtgtgagccactgtgcctggcccagaattgcatttctaacaagctccagggtgatgctgatgttgtggggtcaggagactgtgctttgaaaaccactgatgcagtcagaagatctcagcttggttcttgcttcttgggagttcatcgtccttacagggttgctggaagtctaaagggaccagtacagtgttatctcatttaataacctaacacctcacctgaagcaggagaaggggctttttcaagattcacgatttgtattaatcagagcaagataatgactgtaaaaccagaaggagaaagaatgtgctactcgcagttcaagagtcaatcttttgtttgtttatgtgacaaatcatcttcaagctcacctttctccagggtctactcgaatatcaccttcccatcgaagccttcccttgccccctgtatttacatttagaagcctgtctcttaaactccctacctccccttctttccttattgttttccatagaactcatttcccaacacagtgtagacttctcgtgtttattgtgcctgctttctgaatcacccactaatgtttcagctctataaggtcagggatttgtattcatatcgttcactgtggtcatctcagcacttagaatggtgtgtggcacatagtaggtgcttacagtgagttgaatggtggccccccccaaaatgcatgtccacatcctaagccctagaacctgtgaatgtgatcttacttgggggaaaaaaaaggtctttgaagatataattatgttaagaatcttagatgatatcaccctggattacctgagtaggccttcaatctaatgacaagtatctttttaagcaacagaaaggaaaagccattgaagatggaagcagagattggggtgatgcggcaatgagcctgggagccaccagaggctgtaagaggcaaggaaagattaccttctagagccttcagagggagcagagtgtggccttgttgataccttaacttccgactgacttttgactttcagaactatgagaaaataaattagttgtaagctgcccaatttgtgacactttgtgaggctaactcaaggacactaatatgttcaataatttggtagtatgaatgaatgagtaaatgaacgagctcccagcgtgtggcaggcactgcactgggtactgaagacataatgacaaacaagacagacgagcagtgtcatgttggagattcaattctagaggggaagacagacaataaaactgcaaatgatgaataagatgttagtgatatttctcatagtggtttcctatgaaagaaataaatagggtgacaaaggtatttgaaatggtgagagggctggggagctggtgattggtgctgtttcctgaatagttccaactgcctgccttctggtcccttcataggattgtgcttccttggccccttgtggttgggtagggctatgaaacttgctctcaccaatgctttgtgaatagaagcgacaggtcatttaatcaccattgtgagaccctccagagctctctttctttatgccatggcaattagcaaccagcatcacttgaaagagcagccgttccaccatgctgggttccagaggcagtaaatgtgggccaacgctcccagacaacacccaatattcatgcatgggattcatgcattttgggacagaatcaacagggtcaagcttggctgctgggtgtgtagcatttggagctcggagtatggtggtgccatttcccaacagggaagtctggagaagactggcctctcacgggctgccacactgcatagtgctggaggggcagccttaccccagaggcagggcaggcagggatgtgacattgaagaggacactaactggtccaatggttaccttgatctgctgaccattgcctcactctaaataacaattggcacttttaagctgggcgcagtggctcacgcctgtaatcccagcactttgggaggctgaggcgggtggatcacctgaggttaggagttcgggaccagcctggccaacatggtgaaaccccgtctctaccaaaaatgcaaaaattagccaggcgtgatgacaggcccctgtagtcccagctacttgggaggctgaggcaggagaatcgcttgaatccaggaggtggaagttgcagtgagccaagattgtgccattgcacaccagcctgggtgacaagagcaaaactctgtctcaaaaacaaacaaacaaaaattgacactttttggtgtcatctaaggttttcacatttattaatgccctaactttccttaatcaataaaaaaaattggttcttttttctttttaagacagagactccctccattagccaggctagagtgcagtagtacagtcagggctcactgcaacctctgcctcctgggctcaagtgatcctcccgtctcagcctctcaagtagcttagactacatgtgggaaccgccatgcctgaataatttttataatttttgtagagatgggtatttgtcatgttgcccaggctgatctcaaactctcagactcaagcgatccacccacctttgcctcccaagtgctagattacaggcatgatagatatgaacctccatgctcaatctagttcttttttttttttttttttgagatggagtctcattctgtcacccaggctggagtgcaatggcacgatctcagctcactgcaaccaccacctctcgtgttcaagcgattcttgtgcctcagcctcccaagtagctgggattacaggtgcccgccaccatgcccagctactttttgtatttttagtacagatggggtttcaccatgttggccaggctgctttcaaactcctgacctcaggtgatccacccaccttggcctcccaaagtgctgggattataggcgtgagccactgcacctagttctttcaaatggctcaatatattatacttattgtattattgttatattctagtactatatattacatatttctctcttcttgcctattgaatataaatattccagttgctctataaaaagatttttaaaaccatcaaggcagcctgtgaattccttgtatttgtgatcaggtaaaataatgccagtataccactaccagtgcctggcactgaaacacaaaataaacactatgtacgtaatgttacttgctgctattattgttgttatatggtaaatattttgacttggtatcttgtaatgttcaccttcttttggtttttatattagtcactaaatctgtgtaatctgacttcttttaaatttctgaaaatgagggcattaatatttgaattacagtgaaagtaactatgaggccccttttttttattttttgtctgcagtgaattactgacttcagtggatttaatcagcactccattgccatctgaatgaccctgaaaaataggaatgtttttaaggcaaattgcacttttcttccatggctacacacagtatttggatgccaatatttcttctaatgagtttctgcatgttactagcctattgatgcacagtgagggtggatggcaggcattcttgggtgcttataaaactcctcttctcaccccagcatcagcaaacacacaggcacacgcatgcacacacacccagcatcttttgtgccaatgcagtcatgactgcattcatgggccagggaagcggtaaaactgggctccttcctggactcaatactgagtctggtttagtctaaagtgatcatcagaatgccatcgcccttgccaatgatcaaggatgagtgtgttgcaaaattctggccaatgaagggtgtacagggagatttctttcattcttgagcaagggcacaaggaaggaatgtttttctgctcctggatataatcttctcaccttggaattaaggtcagtatattaggaaccatgagtggagccagctgatgccctgaagagaatagcagaatgaaaagattaaaagagcctggattagccaggcatggtgctgcatgcctgtagtctcagctacttgggaggctgaggcaggaggatcacttgagcccaggagtttgaggttgcagtgaacagtcatcatggcatggcagtccagcctgaatgacagagcagggccctgtgtagaaaaaaaaaaaaaagaaaagagcctgggttctggaattaaccagccctgaaaccactctaagtcaggagttctgattataagaaatacttttgtcttaactgtataagccacttatagttgcagcttgctaaccagcatctccgagcagaacatgccaggtgatagagtatctgcatcatttcaaacttctcttcagaaagctgtcattcactcagcaaatattcactaagcacctattatttgccaggcaatttactaggtactggggattacagtgatgactaagacatggtccctgtctaaagtcactaacattctgttgggtgaaacagacattaaatgactaacacacttaaaatattttttttcaactaaaataaagataaatgctataaggagacatatagggtaataaataaaccatagcaaaggttctggagggcctgtgaaggcttccaggggaagctgtatttgtgctgagccttgactaggctcaggtcttgactagggccaggaggaatgggttgccttgaatgaattggactaatggtgaattaattcctatgtcagggcacacattagtccattctcatactgctataaagaaatacctgagactgggtaatttataaagcaaagaagtttcattggatcatagttgcacaagttccgtacatcatgtccattttctagtaaagaggaaaggtggggtgagacaggtatgtacttcactttgaagacacttctcttagccgggcatggtgtctcatgcctgtagtcctaaggcatgaggtggcactcaactctagaggtgggctcgaacactggaccaaattgaggactagctaaatcagggagggggtagaagcagctttccataagacatgcccaccagtgtgccatgtcagtttaccattgccatggcaatgcctgtgagtttccctttccatggcaacaacccaatgacccagaagttactaccctttccctagaaatttctgcataaactgcttcttaatctgcatgcaattaaaagtaggtataaatatgaatgcagaactgccctgagctgctactttctgcctatggcatagtcctgctctgcaggggcagtcacagagctgcaacactgccggagctataacactgctgcttcagtaaactgttttcttctactctactaacagcttacccttaaattctttcttgggtgaagccaagaactcttgcaggctaagccccaatttggggctcacctgtcttccatcagtcccagctacttgggaggatgaggcagaaagatcacttgaagccaggagttcgaggctgtagtgagctatgattgcaccactgccctccagcctggccaacagagggagaccctgtctcaaaaaagagtagacccttctcttctaggtttttataatcacatgtcttttattcaagatattaatctctattagggatagaggttatctaggtttagtaagctattttaatatctagttttatggctaaccagatcctaattaatttacctttattaaacaaatgctagaaatgttcttagcttttcagtctgaaacacctagcactgtggccagctcttactaggatgctagctccaagattagctgtgggaagaaccacaaccgtgtaatttcatctccttcattcttgatgtgcttgtcagcataatggaggcgggagagcctctctaaatggtggctgggatatgcaatgaggtactgtatataagcccaggcagcataagttctctcccagatgctaatctcttttcatctctttacccttttgcaggcctctaagagtacctacggcacactagcaaagggcagtaaggatcctttgtttggaaacagcattttgcagtttacaagttcacaaaatctcttttggagcctgtgaagtacatagtactgtcatgaagagtcagaagaaagtaggtttcggggcagtactgccacttctctgattcggaagcaagttttacctcttagcctcaactgtaaagtagggataataattttggttacttcatagggtgactggtagaatgacataatttctagcaagtgcttgcaacaaagtaaatgttcaataaatgttagattttatcattcattagggactattagcccattagatgacaaaatgaagatacagagagcccacaatgactatactaatatttaataatggcagtattcattgattcaagccttattacatgtccagaaagcagctgttattgaggtatgggaggagaacagtggctgccaattctttgatgtttaataaacttttattaatgtccacagtgaacaaaggtccatgctgactttcatacttgattctaaagattgcaggatgagcgtagttggacacagtcattaatgtgattgttcttgcaataaggggaagacaaagaggcgtgccttgacaattacactactatgtactaaatgctatgctagaggaaagcatgtgatctacctatgcaaacacaaagaaaaagatgtgttagttattgcaattagtgattgctgtgtaacaaatgacccccaaacctaaaatagcaatgaatattgattgtctcacacagtttctgaaccacaggaattcaggatggcttagtaggatggtctggctcagggtctctaatgaagttatcagccttgactgcaagcacctgaaggtttgatcagagctggaggatctaagacagctcactcctagctagcaagctgatgtggccaccggcaggagacctcagttcctcgtcctgtggacctgctgcctgggtgtcctcctgacatggcagctagttttcctcacagcacgtgacccaaaagagaacaaggcagaagccacatgtcttccgtaaggtaggattgcaagtcacattgtgtcattacaggggttggccctatttttggtgggagggactatataagagggaaaatatcaggtggcaggaatcactggggccaccttggagggtggctaccacagaggtcaactggctctatctggtggttcagggaagactttctagaaggggtgatgcctgaaacagctaagtcaggaacgacgatttataacctgggctccatggacagaactcaaggagtctgtgaacttgagtcaggggaggtaggattacagcttcattttcacatacctatattgaaaagtaacattctttcaattatcaacgtaagaacccatgccagtgttgttagtaatacctgtgactttgtcaccagcagaaatttccactgttttgcattcatgtgtggtcaacatggtaagaccccgtctttacaaaaaaaaaatttaattactgttattgtagatatcatgaaatattgcttacattaatcaaaattatgaggctgggtacagtggctcgtgcctgttttcccagcacttttggtggccaagggagtaggatcatttgaagccaagagtttgagaccagcctgggcaatgtagtgagactgtcgtttctacaaaaaattaaaaactagccaggcatggtggcacatgcctgtagtctcagccactcaggaggctgaggcaggaggatcgcttgaacccaagagtttgaggctgcagtgagctatgattataccactgtactccagcctaggtgagagagaaagaccctatctctaaaaaaaaaaaaaaaaaaaaaaaaaaaaaaaaaaaaaaaaaattaacaaaaattatagtgattgtcagacttattgttctcactcacaagtgggagttgaacaatgacagcacctggacacagggaggggaacatcacacactgtggcctgttgggggatgggggacaaggggagggagaggattaggacaaatacctaatgcatgcggagcttaaaacctagatgatgggatgataggtgcagcaaaccaccatggcacatgtatacctatgtaataaacctgcacattctgcatatatatcccagaaattaaaataaaaaacattagagtgatgttagacctcacaccagatcttgatatttaatgcataattaatgaattacagatatttgtatataattttgtttttaatagtttagtaattatatttcaatgtacttgtctttgtaactgtgtgttttacattatgcaattaaggacatccttttgagaaagaaaccataaatgttaccagctgccaaataggtctataacacacatatatacaaaagtagagagtgcagaaggatgaataggaattatccattaaaaggaaaaaagaaatggcattacaggcagaggcaagaagcaggcaactgtgtatgtatacttgtgtattactaagagtttcaagtccaaaaaggggaaggacgtaaatgaagccataaacataatagggaccagttcataaaacattaggctaaagaacctgacctcgataccatgtggtagtaaaggctgggataggagatccaaaaaaatttgatttatgtatttatttaataattatttcttttagaatacataattcatgtacaaatacaaactttaaagtgaatatggcagaatgcttccttttgttacttgctgcggctactctggaatgttttgcaatccagaagccaccacgggtttctttacattctcaagaaaacatttttatgtaagggaatggctgttcagatttgcattttaagtagtttactctgatcaagttgccaagtgagacaaggctttatggagaagctgctggtgagggtgagaagcaaggctaggaatatgagggggagaatgttattctttactttctaaaggagtgaaccacaaagctgtttgcagattccacacatgcagagaaaacacaattcatttggttggtaagttcagatttcttgtgccaaacatgggaagcagtacagcgaggtgattaaaaatactgcacaggccagtgaggtggcttatccctgtaatcctaacactttgggaggctgaggcaggacaattacttgaggccaggagttcaagaccagcctggccaacaaggtaagactctgtctctacaaaaaatttaaaaattagccaggtgtggtggtgtactcctgtagtcccagttactcaggagaccgaggcaggaggatagcttgagcccaggagtttgaggctgcagtgagctgtttttgtgccagtgtactccagcttgggcaacagtgtgagatcctgtctccaaaaacaaacaaacaaacaaacaaaaccccaaaaaacaaacaaacccccaaaaatgcagacttgcagactttagaattgagagaatttggattgagtctctgctttaccatttgctaagtctttgctatttgctaaactaagcctcagttattgcttctatagagcaaggcttttaatacccacctctatctactcctgatgatggtgtatctgataatgcttggaaaacgttccatacagttatgcatatactttaaagtcagatctaacatcagagtggtgcctcatttttgagtcttaaggttctgccagcccagctttaatcaccaacaacaatgacgatagctaacaggtactgagtgcttactctgtgcctggtgctgtgctgagtgctttgtagtcatcacttcctttccttttttcccttcacccactttctggtacctttgcatgtgcatgtctgtcaaaatctggggtgaatcttgggctccaggccctggactctttggaagaacttacttgcaagattataacagcaatggatcagagcggcatcttcaaaacttcggcagccaaaataagacactctaaacagacaatgaaagactttacagtatttcacgcctgtaatcccagcactttgggaggctgaggcgggtggatcacttgacgtcaggagttcgagaccagcctggccaagatggtgaaagcctgtctctactaaaaaaaaaaaaaaaaattagccaggcatggtggcaggtgtctgtaatcctatctactcgggaaggggaggctgaggcaggagaatcacttgaacctgagaggcggaggttgcagtgagctgagattgctccactgcactccagcctgggtgacagagcaagactccgtctcaattaaaaaaaaaagactttagacagaatggacttgttgctgcaatttttgagtgcttgggtccaacatacctgcccccacgggagggtgatttttttccctgcagacaggaatgaagttggactgaaatgccattttaccaatgccagcaagttagccattatatgctacggctactttgaagcttggggcttcagtgaagtttccagtgaagtttccaaacttagaggcctaatttccagaagtcacagcaatgaatgcactcaccaagggagagggcctaagtgtggcccaggagaaaatgtgctttattacttagtcctggggactttcatgataaaacaaaatcaggctctccctgttatgcttcagggaacccatttcacagcctatcataggtgctaggtttacaagctacctagtttaatgaatcccaatctttcagatttcacgcaatagagaaaagctttggtttgttgtttttatcgttatttgtgcattgtttttaatgagttttatagcgagattatcaactttatcaatgtgtcaagaaagaccatttaaaaaaaaaaaacaaaaacactggcctgtcatggtggctcacacctgtaatcccagcactttgggacacccaggcaggaggatcacttgagctcaggagttcaagaccagcctggacaacatagcaagaccgtgtctctatgaaaaatttaaaaattagccagatgtggtggtgtactcctgtagttccagctactcagacggctgaggtaggaggatcgcttgagccctggaggttgaggctgcagtaagccacagtcataccagtgccctccagcctgggtattattattatccaaaataataataaaagtaataaaataaaagtgagaaaacaaatcaataccctgccatcactatcaccttccataaaaggtaaaacattttaacaccaaaacagtagaaaatactacacattacctgagaacaatttttgccaagaatctaataaagcttctggtcttacctccaggttacagaagacatagagacagaggagcaatttaaatagggccatgaggaaataatcagaagaatctttggcgcacattctgtaagacggcatgacctggaacctttagatgtcattgtcacagggaaaaagatttggggggggggcaaatctctagaataaatgagaccaaagagacaagcgaccaagtgcaatgcatggaccttgaatgagttggtgctcagagggggacaaagctataaaagacattttacaaaaagtgaagtgtagagttaccatatgacccagcaactctactcctagctatgagaaatgaaaacacatgtcagctgagagtggtggctcctccctgtcatcttagcagtttgagaggctgaggcaggaggatttcttgaactcatgagtttgagatcagcctgggcaacatagggagaccttgtctctaccaaaaaagaatagaaaagaaaacacatgcctacacaaaaatgtgcatagctgcattactcataataaccaaaaaagtgaaatcaacctaaaagttcatcaagtgatgaatgaataaataaaatgtggcacatccatataacggaatattattctgtcataaaaaggacaaagtattgatccctgctacagtatgaatgaacctcaaaaacgttgtgctaagtgaaagaaaccaggcacaaaagactacttgttatttgattcaatttataggaaatgcccagagcaggtagattcatacagataggaagtcaattaatggttgccagggattaggggctatggagaatgaagagagagtactaataggtttctttttggggtgatgaaaatattctaaaattagatagtggtgatgattacagaactctatagatatactaaataccactgaattgtacactttgagggggtggtgaattttatggtatgtgaattgtatctcaattttaaaaacccaaaataatagtttaggtacaattaattgacataatggagatatcagtcattttcttaggtatgaaaatggcattggggatatggagaataataacctcactcttaggagagacctgctgatgtattcataggtcaattgtcatgacgctggcaatgcattttcatctagctgagctcacacaacagaatgggctctttacagcaaatatgggctgagtaagctgacttacacctcttaatccagcactttgggaggccgaggtgggaggattgcttgaggccaggaatatgagacaagcctgagcaacataacaagacccccaactctactatatacataataaagcaaatatgggggcaggagtatttgcgcattcgttgtactcttctctcaacttttctggatggctaaacattttctttctttctttctttttttttttttttgagacggagtgtcactcttccacccaggctagagtgaagtggcacgatctcagctcactgcaacctccaccctcaagttcaaacaattctccttcctcagcctacgagtagctgggattataggcgtccgctaccatgcctggctaatttttgtatttttagtagagatggggttttgccatgttggctaggctggtctcgaactcctgacctcaggtgatctgcccactgcggcctcccaaagcactgggattaccggcgtgagtcaccgtgcctaggtctaaacattttcttaataacacatgctgggatgagagaaaaaaatcatcagaaagcaataaaagtaggacagatatgatctcagaaaataaaaggacagtactttaagtagaatatatttagcttaagaaattttcatttcttttttctttttcttttttgagatggagtctcattcttccacccagactgcagtgcaggggcgcaatcttggctcactacaacctctgcctcccaggttcaagtgattctcatgcctcagcctcccgagtagctgggactacaggtgtgtgccaccacgtccggctaatttgtgtattttttagtagagatggggtttcgccctgttgaccaggttggtctcgaactcctgacctcaagtgatccacctgcctcggcctcccaaagtgctgggattacaggcatgagccatttcttttttctaatttttctcactttcccatggagtagtgaaaatctcttggcacccgtcagaggaccagagctggggctccactgtctgggagaggcagcgctcagggcaccaagttgacaggatgagttcagggctagtgcccttatttgtattctaaacccagccactgttagctttcgcttgccacgtggccttgggcaagttaacttaagtttcttgtgcctcagtttcctcatctatgaaacttgggttgctaataaacggtgtcttctcataggtggttgtaaggatgaagtgagttaatattggtaaacggcctattatcatgcctggcatgtagtgcgtgctacatgaggatttgttaaataataaaaccccatttctttatagctatgtgtgttcattttctattgctgctgtgacaaatgactgcaaactgggtggcttaaacaacacacattatctcacagtttgtggctcagaagcctgaagctgggttaaaatcatggagtcagacaggaggtgcctttctggggactctggggcagaatctggttctctgcctttttcaccttccagaggcttcccgttcggattccatggctcaaggccccctccttctgtcttcaaggccagcaatagtgcgtcaggcccctgtcacactgcagcactctgacctcccctctgccttcctctttcatttttaaagacccctgtgattacactggactcccttggataatccagaataatctcccctttttttttaaaaaaaaaaaaaaggctgcaccaaaggcatagtctagctttatgaaagggcctatgcatagagtcagtgtaaaaatactgtaagtcccatcagcttaatagcaataaaaattccccaaaatggccagcacggtggttcacacctgtaatctcaaccttttgggaggctgaggtgggtggatcgcttgaggccaggagttcgagaccaacctggccaacatcgtgaaatcctgtctctactaacaatacaaaaaattatccaggtgtggtggtgtagacctgtaattccagctactcagcctactacagaggctgaggcatgagaatcacttgagcctgggaggcagaggttgcagtgagctgagaccgtgccactgcactccagcctgggcgacagagcaagaccgtgtctcaaaaacaaaaaacaaaacccaaaaaatggaaagccgaagggacagaggaagaggctactggacttggtacataaggagcctggctcatggcaccgggcctagccacagggttctccagcattgctgttgctatgaggtcgggggatagcgattgtcttatgagagccactgttcacctgggtcagggaccctcacttctggggtgtgcttgacttctgcctgcccccggtgctgtccagcaggccagagatgaatgctctgggaggctctgcgacaatcgtccccgcagatccacccaccctttccaatgttcctgtttattttattcaattaattaatttatttttcaagaccaggtctcactgtgtcaccaaggctagagtgcagtgatcacagcttactgcagcctcgaatttctggccttaaacaatcctctggccttagaaacagctaggattgtaggcgtgggccaccatgcctggctggtttttgtattgtttgtagagaaagtggtctcactatgatggccaggctggactcagactcttggcagcctcaatgatcctctagccttggcctccgagggtttgggatgacaagagggagctattgcacccggcctcaatcttcctccctaattagtaactttaatttcatctgcaaccttaattcccctttgccatgtaatgtaatgcattcacaggttctgagggctaggatttgcacatcactggaggcctttattctgcctaccacagtacaggaacttttggcagagcgaagtcaatggactgagctaagcaaccagaagaacactagtgtgaggactcacgtcaccaactggacttggcccacagctatagtatttctctttcctgttactgttttagggaataaaacccacatttgatgaaaggttgattatgaacagagcttatgacaaggcaggtacgtggttggaacttactacccagagtgcaggaactacaaaagaagaggttttcatgtttatagaataacaggagaaatagtagtgtctcagcaagagagagtgtggctgccggctggccagggtgtgtggctggttcatggaataaactggagtagaacagtctttcctcaatacctgcatataactgacatttaattaatactggtagatgaactgacctccaaggccaagtctcttttactctgtcaactgcttgaccaaagaaattggaagttcaccagatcccctttaatgccagctgaaaaataagaaatggacacgtgtaaacctagataaggcattaacaggcagacataatgaaataggggaatgttttagaatccattattttttcccctattgaaccaaatattaaactctcattgcttaaattaattttagcttaatagtttaaaatattctggcttctgcaatttacattgtaaatttctcatatgtgtttgctgccttgtatgaagcaatgttaaaataaagctaaagtcaccattcaagacattaatgacagtctggatatgtggagacacaaatgagtggactgggtgaatagggtggtgatggacagatggacggatgcacagagacagagggatggggaaatgaactcataaaggtgaaaatgcaggagtacaaagaggctacattgcatagtggttgacagcagatgttcaaataccagctctgacatttactgggtcaccctgggcaagttacttaatccctccatgtctccacttgttcataaaaataaaggccatgtggatgagcatggtggctcatgccggcagttccagcactttgggaggctgacgtggcaggattgcttgaggccaggagtttgagactggcctgagcaacgtagcaagacccaatctctacaaaaaaaattagccaggcatggattttatagataggcttgaggaggcagtgtctgatttatgtagggcctacagattgtgtagttgttctcgtgtcacaggtgtgacgtttacatattgcatggggaagactggccactccactctaatcttattaagcagataggctttccacttggtcagcaccatgttgtctgctccctactgcacacatggtttgaaaggaaaaaagaagatggagctaccgttttgaacacgcctagtcccacgtagccttttcctattggcacagctgccagcattcacttgtgcaagcttctagcttgcttgcccatgtttgcagctcgattttacaggctgctctttgttagaaaagaaaatgatttggagactgcttttcatcaaaaggaaaaccttatcaatggttcccataccctcactatctgcctaagtaattactttttaactcctatgtcagtatcagtgggacctgacactgggctgaaccaggggtgtgcagggaagaggtggaaacagagcaattgctaaggaggcactgaggcccctcagacatttgcaaagttctgacgtcattgttttaactgtgcctctgttggcatcctaggttaccaactcccaggcaactacatcctcctctcctaccctacccccattggccatgttgccactctatcacccaaattaaatcactgttagttctgagagcagcttgactggattaattccctgtcaatgcattccccacccatttgctggagggcttaaaaaatgtaaatttgggcctgcaaggtagctcatgcctgtaatcccaaaacttttggaggccgaggtgggcggatcacctgaggtcaggggttcgagaccagcctggccaacatggtgaaaccccgtttctactaaaaatacaaaacatgagccgggcatggtggtgcgtgcctgtaatcccagctacttggggggctgaggcaggagaatagcttgaacccaggaggcagaggttgcagtgagccgagattgcgccactgcactccagcaggggcaacaagggtgaaaatccgtctcaaataaataaatatataaataaataaataaataaataaataattaaataagcaaatttgattgtgtcactcccttgcttgaaaggctcccttggctagacaggtgcttggctatatatcctagaggtttctcagagtaattcttaataacaccctcttgctctctccaatgtgtctccattaggaatataaagttatatggtcaccctacttaaggggctcagagtgatcttaccacttcccctcctgaccccatcacaggcttctgcagctgtagctaacacttggagtgtcctaagtgctgatgctggagagctactgtttcctcctgttgctctcagatccattccctccctttcttctggagaggagattcttcccaggtgcccaaagccctctggcttctgagtggtttcatccgatgagaagccctggcaggtgacttcagggagccagctattcttctccccatgacctctgcagggttttcctgcagcaattattctttctccagggtccagtcgcctcagggcagcctgtcgtggatgagcagtgactatgtgggctggtgtcgtgggtgtaaaagaatgaaccaagacagttgtaggtaaagaaaggcggatttattaaaggcagtaggaaaatctgttgcaaggttgcaatgggcagaatcagcagaagaggagctgacggcaaggatacaaaggcttgttggagattttatatagttttaaaatgattcttgggctgatggataacgccaaggtagcagggagctaacttgcattcttctgtcagccgaagtgtttgataaattgaagagttagatgacaagcaggaaacttgtgtgctgtgtgcgttatctgtgcaggagggccatgtgtctggggccgtaaagaaaggccgatctatagcttcctctttgctttcccctggtcctgccagcctgactcctttttcctaattaggactccacatagcccccttcttgcctctggctccctagcttctgtcatagctcctcttcgtccctccagcctgtgtcctggaaatgactttccattctggctcatctctcacttgcatcattagcccgaatttgtcttctcagctgttccataccctgtgtaatgaattccctctgtcaaattcgaaatgtttgctggtgttgggagctcatgcctgtaatggcagtgctttgagaggctcagtcaggaggaccgcttgagccaaggagttcgaggttacagtgagctatgattgcatcactgcactccagcctgggaaacagaccaagaccctgtctcttaaaaaaaaaaaaaaaatccaaatgttaatcctggcttattttcctgatcagaccccatcatatatatgatgacatgtgttgacttatttaatatcgtaacacggctgtgaggtgggcattactattattttcatttttcagacaatgaaactaagggaagttgaagggcttggccactgtcacagtttgtgacataagttgggttcaaaagataaattacaggaaactaacatgggaactctccctgtttcagcataccttacaggtcttggtttaaatttgtcttagaaccttcaatccacagttctttgggttgactgttgaccttctgctaattcactgttatttctggatataaggagtctctctctatatatatatcagagacagcttttttttttcatttgtgtgtttgaatgaatagatgaaatacaaacatatcttcctaaataaggacgcattgattagaagagttttccataagactgctgttcaacattcttccttattggttacttctcaatgagaaattatccgaagagctaggatgcctcccagatctcattggtacattgagttttgcaccaaagcatcaggcttaattttccaaggaatggcaatttaagttaaatcaggtttgcagagttgtcggggtgtttgtgtatttgaggttgggaggggaaggaaacgatcatcttcagggtaatgataataaactaataaaatgtggctccaggaatgttgcactaaaactttgtgcctcctgcatacatttcttttgagtaatgccaaattgtgttcagtaaaatctgatcaatcttatgtgcgtaaattgtcagttattgcagaagtaatcagtcaaaaagaaaagaaagtttaaatgtagagacccttgttaggagctgggctttagcctttaaaatcgtgggtggatagggccatctggtgtgcagttgtgtaactagacattgctgttttttttttaacctccttgctaataatcaatgtgattcatttgtctttacaaaaacaaaccattcttttgttttgtttttttttcttcaacttttactttaatttcaggagtatatgtgcaggatgtgcaggttttttacacaggtacatgcgtgccatggtggtttgctacacagatcttcccattacctaggtattaagcccagagtccattagctattcttcctgatgctcttcctcccctcctgcctccctctgacaggccccattgtaggttattctcctccatgtgtccgtgtgttttcatcagtcagctaccagatagagaacatgtctagtctgttttcatgctgctgataaagacctacccgagactgggaagaaaaagaggtttaattggacttacaatttaaaaagagatttaattagacttactccacatggctgaggaggcctcagaatcatggcgggaggtgaaaggcacttcttccatggtggtggcaagagaaaatgaggacgaagcaaaagtggaaacccctgataaacccatcatatctcatgagacttactcacttcacgagaatagcatgggaaagaccagctctcatgattcagttacctcctgctgggtccctctcacaacatgtgggaattttgggagataaaattcaagttgagatttgagtggagacacagccaaaccatatcaatgtggtgtttggttttctgttcatgtgttagtttgcagaggacagtggcttccacctccatacgtgtgcctgctaaggacataatcttgttccttttcatggctacatagtattccatggggtatatgtaccacattttctttatccagtctatcatcgatgggcatttgggttattctatgtctttgttattgtgaatagtgctgcaatgaacatatgcgtccatgtatctttataatagaatgatttctgttactttgggtatataccaagtaatggaattgctgggtcaaatggtatttctgcctctaggtctttgaggaattgccacactgtcttccacaacggttaaactaatttacactctcacaaagggtgtaaaagtgtttctttttctccacaacattgccagcatctgctgttttttgactttttaataattgcccttctgattggcatgagatggtatctcaatgtggttttgatttgcatatctctaatgatcactgatgttgagctttttttcatatgtttcttggctgcatgaatgtcttgagaagtgtctgttcatgtcctttgcccactttttaatgggattgtttaaaacaaactattcttaaggctttcttagggtaacatttggagaacattggctcattcccaaacataagccttctcaaaccgattaaaatctaatcctcaccaagttaagtagggcttgcctgctgatagatcctcatcagagcaaagtcaaagctaaagttcagggggacagaaactgagtaaacagaggaagccagtaaggagagagcagaaaatgtagcccatgggagggaggagacaaacctcaagaggaaaaagttcccaacacttgcatgtcttacttctttaacctcatagaacccaacaaataagttataagaaagggagaagaggccgggagtggtggctcatgtttgtaattccagcactttgggaggccagggcgggtggatcacaaggtcaggagttcaagaccagcctggccaagatgatggggaaaccccgtctctactaaaattacaaaaattagctgagtgtggtgacgctcacctatagtcccagctacttgggaggctgaggcaggagaatcacttgaacccgggaggtggagattgcagtgagccaagattgtgccactgctctccagcctggtgaccgagtgagactctgtctcaaaaaaaaaaaaaaaaatggagaagaaaatgtgatcatgataaccattcccgccattactggagcctggaccagccggccagatttccacaggatgtctctgacctgcagaggggctggcaaggtgggaggcatccagaccatgttacagaactcagtaatcagagcctgtgctggagccaccagcatcccaggaccaccatgtgaacctcctgacaggagcaggctcctcaatgactgaaatgaatctcagcagaactcctgtgattcataagtgactcatttactaacttattgtcagtatagattctccactgggagaagacgggcaacttctggagacatttttggttgttacaactaggagaggggcatctactactcgcatctagtgggtagaggccagagatgctgctaaacatcctactgtacagccccaccacaaagaatgatctggctccaagtatcggtaatgtcgaggttgagaaaccctggtgtcagcagtgggagaagccttagagggaatttccaaagtggtaggatcagcacaggatagaccctgaagtttaaacttcttccagggggaccgttacccagtttggggaacaccatggtatatcactagctgtgggctgatgccaagttacaggtaacagatgccagcagaagctctgggcagaggaaaccaagataaacctaagcagacagtccttgtgaaactgaacagagtcaaagataatgaatggagaaactgaggctaatcagtttgacctcattccttcctctccccacaatcaggggatcttatgactgaatttcttacaaatagcaaaggaataagtaggcttaggtgagaggggaaaggggctaaattgaggggagcagtggagcaacagattagtggtagcagatttatttttatttatctttttttgttgttgttgttaagacagaatcttactctgtcacccaggctggagtgcagtggtacaatcatggctctctgtacccttgaactcctatgctagagcctaggagtaaatactaggattactagagtaatcctccgacctcagcctcccgaatagctgagactacagacatgcaccaccacactggctaacttttaaattttttgtagagatggggtggtgggggtcggcggggggggggggggggtctcactatattgcccaggctggtcttgaactcctgggctcaagcaattctcctgccttggcctcccatagtgctgggattacagttgtgagccactacgcccaatccaatggtagcagatttaaacacaggtggatttggaaaaaaaatcttacgataggtttaatatgagtcagcaggcctgttgaaacaaaacagtgctttgttaagcttgtttttggttggtcaaatgtagaaaggcaggtgtctccgctaatgagtacgtagagcaggaatcctaagcaatcatccatttcagaacatgaagacaaaaagcagctgcccctcccatacactgcccattaaaatacatacttttaaaattccttattttcaattttatttttttgctctctcagaagaatcaaatatatgtaattattctgatggaggcttgcattctttgggacctaggcctgagaaatcacggtcagtagatttccctataacatggggctggggagcaagtgccaaacagggaatgttctgaaaactccttaggcacaagctgaagatatgtttgaggttttggatacagaacatttataggatatcttttggtggtccaagaggacttgagtgtaccttgtaaatacaggattttgtttttaattagattgattcacagagaaccaaacctaaggaatcacatcattcattcatttgttcatttaataaatttgtaggttgaagcatttaccaagtgctggcaatagaaagaagtcccgggtgtgctttgtcagtttagtcgggactacacaaatgagtcaataactgtagtggagtgatgcgatctcaactgccaggaatcccccggctctcctctcttcctgtgcctcttcaggtaattagctatcctttctttcttttattttccttccttccttccttccttccttccttccttccttccttccttccttccttccttcctccctccctccctccctccctccctttctttccagattctggacctattccagacttactaaaggaaattctctaaaggtgaggcagttttttaaagacagcagctctctctgtcgtccatgctggagtgcagtggcccgatcatagctcactgcagcctcgacttcttgggctcaagtgatcctcccccttcagcctcaatgagtagctgggactaccgatgtgcactaccacgcccggcaaactaaaaaaataattatttttggtaaagacaggggtcttgcgatgttgcccaggctgttctcaaactcctggcctcaagtgatcctcctgcctcagcctcctaatgtgtttggattacaggcatgagccactgagcccggcctagctaccctgtctgagttgtgcccactacacaaaggtgtcagctacatgtgatgtctgtgcatttctggcctggaccgcacattaagtgctccgtaaacatcagtctctattatcaacagtctctattatcaatcagtctctattatcatcagtctctattatcatgagtctctattaaacaacagtctctattatcacagtctctattatgtgttttggctgaaagaaagttctctaaaaccaggaaatcaggaatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgcacatgctcagctccctcctgcaggctctgggttgcagggataggagttttgttgtgttttgttttgttttgtccagaccggtattgctcagtcatccaggctggagtgcaggggtgccatcatagcccactgtagcctctacctactgggttcagacaatcctctcatctcagcctcttgagtggctgggactacaagcgtgcactactatgcccgactaattttttaagtatttgtagagactagggtcgcaccatgttgcccaggctggtctcgaactactgggctcaagcaggccacctgcctcagcctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatacgagggtcagttcaggcactgtgcgtaaagcacatagcaccgtgtctagtaggtactctctgttccttaactgtcgttccttgattgctcttaagatacgacagtgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttcttttttttttttcttttgagacggagtcttgctctgtcgcccaggctggagtgcagcggcgcgatctcggctcactgcagcctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggattacaggcgtgagctaccgctcccggcctttttttttttttttttaaagacagggtctcgctccgtcgcccaaactggagtgccgtggtgcgatctcggttcactgcaacctctgcatgccgagttcaagcgattctcgtgtctcagcctcccgaatagctgggattacaggcgcccgccaccaggcctggctaatttcgcgctgttggcccggctggtctccaactcctggcctcaagtgatccgcccacctcggccccccaaagtgttggcattacagacaggagccactgcgtcagcccagaatttctgatttaattggtttggcccctcccctctcccttggtaggttgtaaaatcttccctcccaggtgattctaatctatgcaaggatgtgaaccactgctgcctttggtggcaaggtagaggaaaaacaaccaagttctgatgagttcattcaagacacacacaggtattatgtgacaggcctttggctggcactggttataccgaggcaaataagagccagttgtcatccttaggacccaatcttattagggcacagtgacatgtgtaggagcgtccccacgcagtgtgtataccaggaagtagtgtgtctggcatgaggtgtgtgtaggtagttgggggggtcgtgagggaatatggtggcaccctcacagtaaccttcacttcctgggctcaagcgatcctcccgcatcagcctgttgagtacccgggaccacaggtgtgtgcctccacacccagctaattattacatgttttgtagaaatggggtctcaccatgttgcccaggctggtttgaactcctgaactcaagccagcctccctcccgaagcactggaatcacaggcctgaggcactgtgccaagcccagagcggtgttttgagctcaagtagaggtgggtggggcaggagggcagtctaggtagagggaacagtgagaggagagaccccctgcatggcctgtccaggggcctgtgatctttgtgagggtccaggaatgtgaaggttaaggcagggaagggaggacccatttcaaggatttctgtgccttgccgagaagcttgggctctgttggcagagccagagagtggcattcattcagcttgtgaattctggaagaatttctggctctggagaattaaagggacatttccagcagcagagctccagtagcctttgcagggacggaggcaagctcctgagcgggcacttgctgttcctctcacctgtacatctgttggggaaaggctccttctcatccttcagagctgagcttacatgtcactgcccaagagaccttcttaactgtgggtgtcccctcgaccttgtactagtcaccttgtttctctgcttcttcgtgcttagccttggctgtgtactcctccttgttggccctgtctcccttgcccaggttgcagatgtcatggggcagcttgttcatctgagtgtccccagtgcttggcacccagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcgtgccccctgcgcctgccttcctgctgcctggcctttctcccatctgctttcttcctgagtggcccctggccaggggactcgggtgcatacatggtttccaaacgcctttcctccagccctcccgactagtgtcttaaatctcaagctggcctctctggctccgctgttttttttttttttttttttttaatttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtccctgctggccctcagttctctggatcagggttgaaaggctgaaattctttgggtgttagcttaggatgcctctgatccatcctaacccgacattcccttgatctctcctgatctgtgagcatcctggcccttcttttcttttcagttttaatttttgcgctggctccaaccccttttcattcctgactctggaagtgacacttgtttttctcttggggtttgggaaactttgtggttgttctttctaggaggctgctctttgagtcatttcttttccatattgtttctcctactgtagcagggccatggccagggatagaggctgtagctcccactgagacctcggggtctggtggaacccggtcttgtgtgggtgctgtcggcctctcctgctttcccacctgcctcacggttcacttgtgtgcctcaaaggcacacatgtcctagcactccaaagcccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtgaagtctagatctccctgctaacttacactgtgctcaaaacacacacacacacacacacacacacacacacacacacactggctgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacagaatgagaccttgtctaaaaaaaaattaacagaaaacaccccatacgtggaagtgtggtattcacataatatgatgttcacttaaatttgaatcctttggtttaagtttagattactcttaattatctttttaaatgacaagctcgttgaaagaataaaaaatcaaagacggcttctatttaaaggagaataggagaatgcttaggggacatgtgttctaattttctcttcattaaaaagtcatttaaggttataattaaaaagaacatcttttaattaatttttatatttattaaaaaaaagtcttctattgaaaggtacagttcttagttcttcccgtgttaactcactcggttctctataaccccaagaagtaagtgctgttattgtccccatctaaactgttgaggaaactgaggcatgggattaaatgacttcttcaagggcagagtggctggcaaatgggagacccagaaaaccttggcagttgggcttcagaatcttcacgaccaaattactctctctgcttcagctggttccggattcttccccagggatggttgtgtcctgcaggggacggctggcaatgtctggagatgctttctgttgccacagctatgggactggggtattggcatctgatgggcagaggccagtggtgcccaaggcagccccgcaacaaagaatgatgcaggccgggtgcagtggttcacgcctgtaatcccagcactttgggaggccgaggcaggtggatcagttgaggtcaggagttcgagacctgcctggccaacatggtgaaaccccatctctactaaaaatacaaaaattatcccggcatggtggcaggtgcctgtaatcctagctactcaggctgaggcgggagaattgcttgaacctgggaggcagaggttgcagtgagctgagattgcaccactgtactgcagcctgggtgacagagtgagactctgtctcaaaaaaaaaaaaaagaatgatccagccccaagtgccaccagcagtgagaataagaaaccctgattcaggcatgttctgtgaaagtcaagaacgtaggttgacagagtttgttttgttttttaaatgtctttctgaataaataaaaactgttctgagtgagttttgtagttcctttggaaagtattcattctgtttgtttacatttgtgcgcctgctgtgggccaggcatgaggctacatgtctgagggcccagcttcaccttctaagggctgggaggctctttctatgccagcctgcctgccaacaaggctcagcttccactgttaagggtcattttgtggatttttttattttttatttttaggttgagtcttgctttttcgcccaggctggactgcagtggcgtgattttggctcactgcaacctccacctcccaggttcaggaaattctcatgcctcagccactcaagtagctgggattacaggcatgtgccaccatgtctgtctaatttttgtatttttagtagagatggggttttgccatgttgcctaggctggtctcgatctcctgggctctagcgatcctcccgcctcggcctcccaaagtgctgggattacaggcgtgagccaccgtaccccgccactccatggattcttgagggcagagttttttggagccaggcttcaagcacatttgatgtgtgcctatgagataaagactgcttttaatggcaggcaaggaaaatgcaagtccatctcttaactttcttgaagaagcttgagacacagctctgcaaggggctggaaggtttcatgttattgccaatgcttggtttatctgattgctgttgccattcattttgaaggagaagcaggagttggtataccaatattcccactgtgccagcagagagcgggttatccttactagagagccagagagtcagaacggtttttttttgttttttttttttttttttgagatggagtttcacaattgttgcccaggctggagtgcacgatctcagctcaccgcagcctctgcctgccgggttgaagcaattctcctgcctcagcttcccgagtagctgggattacaggcatgtgccaccacgccaggctaattttgtatttttagtagagacagggtttctccatgttgttcaggctggtcgcgaactcctgacctcaggtaatccgcctgccttgccctcctgaagtactgggattacagacatgagccaccgcgcccggccacagagctgcttttttttgcaagtgatattggatggtggttgatgtacaaagtaggagtttgtccttgctactgataccgtagctggtacaaggttttaatcgttctccaagcactgtcacaggtgtcatgtgtctcgccttttcagcagctctgtgaggtggcagtagccctgaggagactggctggactcagctagcatgggctgctcaggtcttcagcgtgctgagtgaggcattcctgcactatgacagagacccagctgccaagactttgtcaaacagaccagaagccagcagttcatgaaaagaccttgcttgcaagttgtagaattttttagaaaattcgtgctctctgtatttattttctgtaaaataattgatagggaaagaatgttcacatcttatcatctagatgttgctgattaaataatataactttctgggttggcatgagtaggtgaacttttaggaaacgcagcctacccttcgaatacctcttgtagcacctggctgtttcccttttgaaataattgtatgttttcctggataccttattacctggtgacacgtgtttctagttattgacctatgtttttaattataactttgggtggtggtctgaaatgaaatgttaagtttgacgcaaaaataggactagtttgtgtaactgatttgttcagaataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagatgccctatgggaaggtcttactgcatctcttaactacctcttgggaccagttaggaaccagtgcttaatgaaacactttgaagttacatctgtggaaagaataaacattttagctgggcaaggtggcacgggcttctagtcccagccactcaagaggctgaaataggagggttacttgagtccaggagttccagtccagcctgggcaacatagtgagaccctgattctttaaaaagaaacacaaataaataaacattttaagagattatataaattagatattatgaattttgtccctacatcgtggaataaaaccaaaacaaatacacagcaaaatgcctctagatttatttatttatttatttatttttgagacagagtcttgctctgtcgccaggctggagtgcagcggcgtgatctcggctcactgcaacttctgcttccctggctcaagcgattctcctgcctcagcctcccgagtagctgggactacaggcacgtgccactgtccccagctaattttgtatttttggtagagacagggtttcaccatgttggccaggatggtctccatctcctgaccttgtgatctgctcccctagggctcccaaagtgctgggattacaggtgtgagccaccgctcccgacggcctctagatattttgagtgattcagcaaacctcctaaagttgaccccgtagctggggtcacagtcctctttctccttcttccccctacttccttcttatatctggctatctgggagagaaaaaatttaatacaattgattactttttagaagagttaatttttacttattactgtggattttttgttttttaacagtcacaccgaggagaagactcagtgggaacatccaaaaactggaaaaagaaaacgagtggcaggaggtttgtatgttgttgtctaaggatcttggatggaagcattaagtagatgaggaaatgtcactggcagagaggtgacaggttattgtgtgtttagggagggctctctggtagagaaccagactcccactctgaggagcttatgggatttggcagaagaagatgatgagatcatagggtggagtgaggatgatttcttactggtcttaaagtaccaaaatggccagatgtggtggctcatgcctgtaatcccagcacttcgggaggccgaggcggatggatcacctgaggtcaggagtttgagactagcctggccaacatgttgaaagcgcatctcttctaaaaatacaaaaattagctgggcatggttgcatgcgcctgtaattccagctactttggaggctgaggcacgagaagtgctcaaacccaggagctggaggttgcagtgagccaagatcacaccactgcgctccagcctcggtgacagagtgagatgctgtctgaaaaatagcgacaacaacaacaacaaaaaccagaaaataattgaggcctttgattcacagtttatgatgttttcctatcgttgcagtgtttataaaattgttcttggctatactatggaattaaatatataagtatttggaaatttcgtaaagattaccatgacttctaggtgattctgagataatgtatgatccacggaatagaagtataagaaagggacaggcacggtggcttgtgcttgtgatcccagccctttgggaggcagaggtgggaggatcacttgtgcctgggaattcgaggtgagcctaggcaacatagtgagaccccatctcaaaaaaaaatatgagaaggttcctgcccttaagaggtttaggatccagctgaagaatcaacatgtgcacatgaaaaaaaatggccgtgccctctaatgtcatatgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcccttcctgacccagggatggtctttacttctccctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagaccattctggccaacatggtgaaactccgtctctactaaaaatataaaaatgagctgggtgtggtggcacgtgcctgtggtccctgctactcgggagggtaaggcgggagaatcacttgaacccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgctatttagcagctctagagttattattttgtacagatatactataatttatcaaattgcctattggacattaatgctaaattcctgttatagagaacctataattataaataatgtattgagcatccttatctgtaagactttttcacctctctgattctgtctttaggataaattccggtatcacgcagcaatagtaaccacctgtccaacatatagcatgagccaggcctgattctaatcatcttgtatctgtagcattaggtcattggatccccacagtgccctgagaggtagtattgttattatccctagcttactgccagtgacacagacttgagggggtaagtgacttgttaaggatcccacagcaaagaagtagcacagccaggctttgagcccagcacctgctccagggactgtactcttgaccaccgtagttaagaggagaattaatgtttcacaactgtcaacatttaaattagaagcttgaatagtctttgacaggattaggattggttggttaatagaagttgatttgagcaggaattttttttttttttaaagttatgaatgtaacataaacgtttcagtatttgattcaagtacaccaacatttaggggtcgggccagccctcctctgagtgtgagtccacttgcatggatccagtgtggtcttccttcccctaagcatgcctgtaacataacatctacaatttctactttcattttatgtgggcgaaagagtacctaggtgccgaggcaagagactgaaggcacaaactgtttcagtataataaagaaagtagttagaataagaatagtcataatacaggttagatatggagatgatcatggacaattatcaatcattactataaacactattaatcattagcttttaatattactctttgtggcattactaacataacctaggaataactggcatgtataggctcaggtgctaaagggacattgtgagaagtgacctagaaggcaagaggtgagccttctgtcacacccgcataagggctgcttgagggctccttggtcaagcggtaacgccagtgtctgggaagacacccgttacttagcagaccgcgaaagggagtctcctttccttggaggagtcagggaacactctgctccaccagcttcttgtggaaggctgggtattatccaggcctgcccacagtcatccggaggcctaaacccctccctgtggtgctgtgtttcaatggtcacgtacgttgtccgctttcatgctcctcccgtactcctggttcctctttgaagtacgtagtagatagtggtagaagaaatggtgaaagttttaaagtctttgatctttcttttaagggcagaaaagaaaatgctgacgtatgctgccttctctctctgcttcggctacctaaaagggaagggccctctatcctgtaatcacgtgacttgcttcaccttgtcaatcacttagaagattcaccctccttaccctgcccccttgtcttgtatgcgataaatatcagcgtgcccagccgttcggggccactaccggtctccacatcttggtggtagtggcccccaccctgggcccagctgttttctccttatctctttgtcttgtgtctttatttattacaatccctcgtctctgcacacggggagaacacccgctaagcccagtagggctggaccctacaactttaaggttgagcaaacacagtattttcaaagaatctgattgctacatcatttgggagttttatggtatttttctagcattttcactgtagttgattgaaccaaaactttttttttagctgcttgtctttgaggctctccaaagcattcgaccacattttcatagataccactgacactatttttcacctcccatgttatcagtttgtgtaatagtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccataggcagccccaggaagacggggctgtctagcagttggataggtgggagtgcctattatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacctcctggactcaagtgatcctcctgcctcagccttctgaggagctgggactacaggctcatgctgccatgcccagctaatttttaaagactttttttttgtagagactgaggctcagtatgttgcccaggctggtcttgaacttctggccttcagcgatcctcctgccttgacttcccaaagcattcatattacaggcatgagcgaccacacctgactgaatttcttaaattttttatgtagtcaaatcaattttctcctgtgcagtctttgcctttgcattcacgcttggaaagttactccctgaaatgggtattaatcaaccaagagcagcagttctcaggcatggttcctggaccagcagcattaatatcacctgggaattcaataaaaatgtacattcccaggcccccaccccagacctactgaatcagcactggggtggggcttgcaatctgcgctctaatagtcatccaggggatcctgatgttccctagcttgagagcctcccgtctagagcaggggctgtctcctttgcctgtaaagggctagataatatgttttaggatttgcagggcatatggtttctgttgcaatgattcaactctgcctttgtagtgctaaagcagctatacacaatatacaagtgatgggcgttgttgtgttccaataaaactttatttacagaaacaggcagtgggccagatttggccagctcctggtctaatctagaggagtaagcaagggctttggggggaacctggaaattggctcccctggctagttctcacttttctgagcctgttgcagtggggtgctggtaaatgtttagcaccaggtcttcagggggaaaaaagccactgtttgtttccacagtataaatactttggccatagctgatttcatgctgccaaggtgaagtgaggaattgggaagagatagtcacgtttggctcttgtaagccagtttgagccagtctagcatagaactgctctgttgtgtgtgtataatattggggtcacaaattaaggttgttataaatagaatgaggatgaggatggtaataattagaataaaggttggattattactcttgagtcttggtacttatagggagatgagtatatattttaaactaattttacacacacatacttttaaaatatgaaatttcatctatatttagaggcttcttaatagtttttaagatattctgaggtctttatctcatatcccaagaatacatttaagatataaaaagtaaattctattataaggagtactcttttcatccatatgtgccttttttttttttttttttttaatggttacccagggtcttggtctgtcacccaggctagagtgcagtggcacaatcatggctcactgcagctttgatctcttaggctcacgtgatcatcctcctacctcagcctcccaagtagctgcgactacaggcgtgtgctatcacacttgaaattttgtttagtgtttgtagagatgaggtctaactatgttgcccaggctggtcttgaactcctgggctcaagtggtcctcttgccttggcctcccaaattgccgagattacaggcgtgagccactgtgcccagcctccagtatattttaataccatttctacaagatttagatcaattccaaatcaaaatgagtgctcgtaggaggtatgagtgcagagtcttaaaatgaaaatcgttagaattttggtagttggcaggtttcttatttacaactaagactttatcattttgagttttctacttctctacgtctttaggcccttgcacagggctaagagatttaattgaaatctactgaaaagagtggctgacagatcttatagctacatttacatgaattacataaaagcccaaaaccttctcaagaagccttttttgagatctaaggatacatggcaatagttattgtatgttacagcgtatgttataggcagttctgaaggaaaggattcgatgactatctttttttggcacaaatgtgatccttctggaggccagaagatagattcagtgggccccagttctttcaggtttaaggaataagcattttggtctatgaaaaatggggttttcctaaagtataagattgtcttatatttataaatgcctgtgttcattgctgtgggttcactgctttctcttttgggcagccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaataggtaggctcttcacttagttatttatctttgggactgctataatgagatccacttagatctagctataatggaattttgtttagtggttctctgatttaaacatgacttttatccttttcagatatcgtttcattaacatcactacctctttttaaatcctaatgttgtcatggaagcctgtgtaggggctgaccttgaagtctctgaaagctgaacactcagcaaaagactgtggctattttggtattcagggatgagagacaacaggctccgtctaagagtttttgacctggtctgcatggtgtatgggcatattccaattacctgggttattcaaaccaaaattgattggtaatagaatacggggaacaacaaggtattatgtctttggaacaaaggatactacaggtttcgactggtcactgagcatatcattttcttttgggcacaggatcttatttctctataaaattggagaatgagttcctgtcttcacctcttaattgccaatgtttacccacagggactatcatgggtagatggctcaagagggtatccttgcttcaatatgatgggccattaaggagacaggagcaaggcgggagcaaaccataactcttcataggattttattctgattttgctttgatctatttacataagtatctgaatcagtgagaaccacctgctttgagtttagatatgcatcttcagatttgtcgacatatgaaacgttgcatttggctgtcttctgtcaagttctctctgtccttttggtcccccgcagccctcacacggcccccttgatgccctcctctactcatttgtttctctttcctaattttgtttttatttttattttttgtgggtatataaaggtgtctatatttatggggttcatgagatgttttgatacagggatgcaatgtgaaatagtcacatcatggagaatggggtatccatcccctcaagaatttatcctttgagtgataaacaattcagttatacccttttagatattttacaatgtgcaattaagttattattaactataatcaacttgttgtgctatcaaatagtaggtcttattctttctttctatcttttttgtacccattaaccatctgcacttctttcttaattttgaacaattccttgaagctgcagaaatattttctagcatgattagggaggcacaggaggtaaaaatacattgttcaagggtcaattattgtgttgtacaaggtgtgaaatctaccaggttgccatccgagtggagaatttttttactgtacttgcctatgaaggtaaagaagcaaatggaaatttttttttaagaattgaaaggattttatttcaaatcaactctcatacctcatcctgggctccaaatatgttcaatccacttgtctgaacttctgcattggagtaaattttatataattgtcattgaagtcaaaactgatggcgtaatatttaaaacaatggctggatccccaatctaagaagaatacattttgttgatcatattaagtactgttacagtgaatgcatggacccatacaattgtggaataattaagaaaaaaggacttaagggcttaaaaatgtctttttaacaatttaacaagttagccagaaactttaaagatcttattctcttaatcttctagctagactctttttctgtaatgagtaagatatgtgactactgattgttttttgtgttaagtgttcgaactgctccatgtgacattagatagcagactcttgaatagagctaatgctctttcaaagatttgcaacagcagacctgcgacattgtaatccaggactgatagagttggttcagaatattaaaagggtgatatctagttagatacataagtcttgatggagaggaggagattctgaagcattgagaataaatttgtggttgctgagaatggccctcacatgttggagtaaagccagaaactctttgtgcctcttcacagctcccacttccccctaagactcttccttcctgatacctataattcattttgtggacactgcaggaggtgtctgcggtccagttggaggttgtggcaaattgtaacgctcaggatggcacagatgtcgcacaaggtcttagggagaccagcctttcctattcaagtgcccacagctctttccccagctgtcaccttccgcaggaatggcctttaacactgtcacctcaccccattcccctccactcttgggaagcatacgtctaggtgagtggtgaagatttttattctgaatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgcccaagtaggctgtggcttctagataaagtccttctactaagctatgaaacatgccaatttataaattgctatcactactttagttccgctcatttaaaatgaaatagctgaatgccgagtgagtgaattgggcatctttacttccaagacttctggggcattcaggagtcatattctatctaagctttaatggtgttggtgttccctttcctttggccactcaagggagcctgttttctttggataaaccgtgaaatctttaaccctgtgaatgtccgttttctctaaggcggggtgggctgaaacataacataacaggatttattttgaaagtggtgactccacaataaaaacatagatatctaatttgccttacaaaggccgatttgcaaatctagtatttccagtggttctttctttctttctttctttcttttttttttttaatgccccatatgacgctgctttgttggaattgccattggtgaggatctcactgataaagaaggggacatccctcccttgatagactttagggttgcactagagccatgccccctttgaagtggcctctaagcaaactctgtcttgtcatcattttcctctctgcagctgtaagtgatacggagctgtattttgagtttttgatactgatattactaaggcaattggagggattcttaattcatctaaaaaaaatcagggattctgacagataaaaggatttggaggaaatgtcagaataaagcattgtgggttcatgaagtcctaggttttataattaaggtttataggcaggtattaccgctgctgactggattcaactgtctggattggagatgaacaaactgccatctctgggctaactctgacccactgcctgattttgtaagtagaattttttttggaacacagccatgcccatttattcccattcctataatgttgaactactgtttgtgtatattcagttatcccaaaataatatggccctttgcttgttaccagaagagtcgcccagttgtggcagagatcatctagctcgcaaaactgtaaatatttactctttggcctttcccagaaaaaagtgccgactgctatgttagatactccagttcattgaaagtgatatcaccctaacattctctaaattagccacagcttagatgaaatttaggcaaatggaatgccccaggccccaggaagactgtggcagcacattgtatgtaactgttggggatgttgcctgaaacccccgccttttttttaggcagctgcaaggattagaatgttgcctcctcagaaactaacactcttctctccttgacctttgtttaaccagctttctgaacctgaagaactttgtagattgaaagctgtagcttgtggacctctctctgtggagatcagcatctcagtatccagggggaagccatctcttcacccaaagcttccgctaggagatcaagaggcccggaaccccgcagtcctgaatgctaaccagtagagacaagggaggaattcatttctgtttgtgttcaacatagactgagcaggaagggccaggtgttttacgactctttggagttagcagcttgttggctctgatttggtaaaagcaacggaaatgccttcagcacggtgaacattacatgcaaatgttgggaagtgttaggaaagggaatttttttaggcgagggaatttcgcattgaggaaggtccctgcttcgtttttagacacagcctatcagtcagctaatttggctatgcatataaatactttagtataaaatgctgccccctgctacctgcaggctgacatgttgctcatcaaaggcaggatccttctaatgagggattagttggatgcctaaatgtgggaccacctactctgttcattgtcttaattagctagatgtttgttggagcgcatgcaaattattttctgtaagcagacagatttattatcatatttacggagtgacatccagggtttgtgagacatccattaaatttttttttttttttaatgtttgagatggggtctcactgtgttgctcaggtgttggtctcaaactcctgggttcaagtgatcctcccaccttagcctcccaaagtactgagattactggtgtgagccactgtgcccagatgctattagcaagtatgaacaaattagatattttcagtctactcttctgtggtaatgatgataaaacttcttaactttcagtcctaaaccagcagtggctaaaacttgatttttaaaatttttttcagagtttggtccagatgaagtttctttcaccttgcgaacctttagaacgctgggctgcatcatgtgtgttgtaactttaaagttagaatagcctagcttcgttacagtttttgagccaaaggacccattaacagaaacaaaactttttttcctgcaaacaaatacaagctggccacactggtaaataccagtgaaatatattttgggactgacacttgcattttctattggtacttatgtcacaaaatcacctctctaacgtgtattacatggacctatatatatgcatacttacatatcaaaatgtatatattttgaggtataaaaagtacgtgctcaaggtattggtcactcctcaatttgttttccttgaaacaaaatgaaggtataaatatttcagccgggcgcggtggctcacgcctgtaatcccagcactttgagaggccgaggcgggtggatcatgaggtcaggagatcgagaccatcctggctaacaaggtgaaaccccgtctctactaaaaatacaaaaaattagccaggcgcagtggcgggcgcctgtagtcccagctactcgggaggctgaggcaggagaatggcgtgaacccgggaagtggagcttgcagtgagctgagattgcgccactgcagtccgcagtccggcctgggcgacagagcgagactccgtctcaaaaaaaaaaaaaaaaaatttcatgcagggaatcccaaaatgtaattatagtgtgatgttgaaattgattgtcttagcttagagagcctactttttaaaacttagggtcttgtttctaaatcatgtgttgaaattacagtgtgaactgtagttgccatactctttgatcctacaaattgtcaccacgatgaattcatatcttgtgcaaattttaccagttctacgtgaatagaagaaaattactttttcttcatgtagagaagggtattcattcctaagattttaaatccacacttcccaattatggactacgccagcttcctttacacctttgcttctttgttttcttttccatacctaaatgttactaaattttgcctttgagcctaaagcatgtcattgatggtttttttttttctagttattccaaaaggtcccataaatctggggccatagctaacttacatttagtcattttcatgggtaaaacacactcatatgagatcattgcacttgggatcttgaaatgcctgattagtttcctttctgattgttgaccagacttaaactagtgggatcttggcatttatctttttaaaaacctggtgctcattaaggaaaggaaaatattctgaaataatcgaaataaccttttgggcattggaactccattttaaattaaaaacatttgtgcctactattatcttatgctaaattatacccaggtattgtaagtaaaattattttgaagttactttgttctaagaaactatggagattcttgacagtgttagacaaagtccttaaatgacattatataaaaattgagaattagtaccttatgacttaaccattttacactgagatattattggacattgagtgtacatggaaatcacgtgatcaaagtatttgagaagtaaatatctaaaggaagagaccaatttaaaacattctaatgagcatcatctcataatttggtaatctcatgtaaaatgcttataataggggtgtgtgtatgttatatatatttttaaaataaatttgtaatcatgtatacagtagtccccccttatccgtggtgtttcagtttttttttttttgagtcagagtattactctgttgcgcaggctggagtacagtggcgtgatctcagctcactgcaacctttgtctcccagggcctggtgattctcatgtctcagcctcctgagtagctgggattacaggtgcacaccaccactccctactaattttatgtttttagtagagacaaggttttgccatgttgtccatacaggtcttgaactcctgacattaggcaatctgcttgcctcaacctccccaaatgctgggattacaggtgtgaaccgctgtgcctggcccgtgtttcactttttgaggtttcagttacctgaggtcaacaggcatctgaaaatactaattttgagagagagagagtgtgagagaccacatttacataacttttatacagtacattgttatagttctattttattattattgttgatctcttactgtgcctaatttataaattaaaatttatcctaggtatgtatgtataggtgaaagcatagaatacatagggtttggtactatccagttttcaggcatcactgtgggtcttggaacgcatctcccgaggataagggggggctactgtcagtgtgaacctgattagatctcaactgaaacttttttgtcacatgaggccatcagttgaatttcatgcctgcatgtaggtttagattttaattacttttttatggtgtcagcataacaaatgagagtcatacaaactattgtttaatgacaaagtgggtcaaacccataattaaaaaaattaataatagatttttgttctacttgaggttttgtagcattacgtaaagcttgaaaacttggaaattgttttacttaaaacccaattaaaataatttgatcttttgcttttacatcatagagtggcacaataaaaattgtaatggaagatgttattttacattttttttctttttttttttttgagacggtgccttgctctgtcacccaggctgtagtgcagtggcgtgatctcagctcactgcaacctccgcctcccgggttgaagtgattctcctgcctcagcctcctgaatagctgggattacaggcgtgagccactatgtccggctaatttttgtatttttcgtagagacagggattcaccatgttggccaagctggtcttgaactcctgaactcaagtgatccgcccaccttggcctcccaaagtgctaggattacagacactagccaccatgcccgggggtgttgtacatatttcctttaatctaaaagcagaaccatctttatatatttttatttttttccactagagggctctgttgccctttgatataattaaacaaaagaggcagcattgcaatatagttctgttcctctcagtccatcttgctttcattttggttaaataatgtcttttacttttctaacatatcttttaggtcttctaattctctgtgatgaagttcaaactgaagactgttactagtgtcgtgtttgtttctttttctctctcttttgttttgtttgtataaaatgccagggatgaagggatccacttaataaaaaggcccattgtgttcagggagcagcctgttctgccaaatcacacaagggcatgtgttttcatgacattattgcttttgagtgtgctggcctagcaataatatgatttttttttcctaagtggaaattgtaatatttaagtattaatacctctgtttaaggttcattttgaacgccttggtgaccctatgtttttttctttgttttttgttttgttttttttttttttgttttttttttttgtttttttgagatgaagtcttcctctgttgcccaggctggagtgcagtggcgcattcttggctcactgcaaccttcgcctcccaggttgaagcaattcttctgcctcagcctctcgagtagctgggagtccaggcacctgccaacacgtctggctaatttttgtatttttagtagagatggggtttcaccatcttggccaggctggtcttgaactcctgacctcatgatccacccgtttcggcctcccaaaatgctgcgattacaggcgtgagctactgcacccgcaaccctatgtttttttctaagaatatagtgtcccttgccccctgctacaagccttacccagtgttacataatttattgtaattaaattgtttattaatgatacattcttgctgtagaagaaaacgtgtccttttgggctcagtacagtatatgtttcttaagtaagagggatcatattaaaccagctacttaatgtgaagcagatagccagtgttctccatgtacaatcttagggagggtaatttttgttttggctgtgtaattatggtttgaggcagcccattaatcgcatatttcagctgtcaaatagaaatttggcccagaaaggaatacactttggctttacaaaactgcttattttcaaatttttaaatggggacaaaaacgaatatgctatattatatacttttatttatataatttttttttcagcaactttttctcttttgaaaatgcaagagcctgaaaaacattgtgaatatacttgtaacattgcaaagctatttcaccagagtaaagatattttggttgttcatatacgagtgtgttcgttgtttatctaataaattgttaaaactagatggcgattctgggaattattatagacttcataataaataagatgctgacagttgaaacccccttgaccgttgcctgtttggtatgacacagaccttcttggacttttgtagcctatacatgagtagatatgaatcctcagccttctccaaaataaggttggggtcactaggaggccttcttggaaagatgtcttaaattaaggcaccagtagatggatcaaaaagcaggttccaatagctcgcttttagtttcttgcctaaatttgtgatctccctttggcttcataaataacggtacatttcatgaagagctggtctcagtctacacaagcctaactgaatggggtgcataggaagggttgcattgtgtgacaaggtttaaatctaattgttttaagtctttgagttatttgctcaccaggctgtgcttgatggttttactttttgtgatttttggagccttcatgttagaagccatagtcatatggtgctctctgaaagcaagacaaggtttcttcactagactctaagaggagatctgagacagagagatgggggcggggaggaaacctatttcagtgtctctactatttctacctaggtggaggataactagccagatgaacggagctaagccttttgtatgaagtttatttcatataaagaggaacaaaatcagaatcaaatttcttctgtagttgcacagaaactgaagttaaagctaatacaatgtttttcatttttacccttacctctacaatgtacttaattgttacagattcgtatttattgattatcatgttgtattacattgatagccgtttaaaatttatgaagattccgtacttgtcatatttaattctcagcaccgtgcttacagctgtcttgtgataatgtcgaaaggaaagagaagggaggtgaggtaacgtgcttgagatcatacaggtcttgggcggcgggtgcctgcaggatagatcaaagggtaattgagtctgtgcctggggccccttccactgtacatgccaccatcctgttgggaggaataacagcacactcctgaatgagctctttctaagcagctcattcattttgttaatcctgagtttggaatcaaccaatttatttaaacccgtgaagcctcgctctgtgcccggtcaagtgctgggagtggcatctgcggggagggccaaggcagatgtcatttccagactgcattggatcctggattcagaagctgaagcttaggagtgggcatggtggttcacgcctgtaaacccagccctttgggaggctgaggcaggaggattgcttgagctcaggggttcgagagcagcctgggcaacatagcaagaccccatctctaccaaatcaaattttttttaaaagctgaagctttctttaccaaaaccactttggtattatgattgtaaaacaaacattaaggaataagtctgggggaatgggaagtagcattcatcaagcgcctgtatatgccaggtgttaggctagattagcttgatgtgccttctcatttaatataagtaattattttaaaggttattgtgattaacatgtattccttatggaaaatttagaaagcgaagaaaaataaaaataagaataaaagatttaaaaaaaccccaattcttaccagttagaagtatactattaatatttagcatgtatgattgtaagcatgttttcccttctttcgtgatttttctatttaaattgtgattatctttctgtgttgttaaatactccacatcttaaatggctgcatagtattccattatgtggttccagctcttctcccagtgtggtacattcgggtggtttccagctttttaatagctgtggaatggagaagcacattttgtaattaaatgtttgtacccatccgtgactcttctatagttttattttgtggaagtggaattgctgaatgaagtgatttgctccccaaccttaatatcttgatttgttttgtcaaactgccctggaagattgtaccaatttgaatgctcctttgcccagcatccttgccaaacttgagaattagaatttttaaaaaatatcacttaaatttgcctatctctgatgattagcaagattgataggcttttcttatgtcgggccatttgttttttaacgaattgccctttcatcttatatgcatgactattggatatgtatcgattactaattgattgcttgcctcatgtgctatcatttaattttcaaaatgtcccttagaagttaatttataaagtgtctattactttaagtacctgttcaatcctgtgatcaagaggaaattcacagagaaagaaattggcctaactcctcagtttgcttcactaaaatcttttaagcacacatcttgtctattatgccagctgcaactcaaatcaaaggcactgttgctttggtacccgcatttaaggagggaataccccaaaaaacttaaacttgtctggctttgcaatggtggtggagtcccaagatgacacagtaggcaagatttgattactttggttatgcaaatttcccctagatcttctattaatgacagtaacagcgcttcagagcttttctatgcattctctcatttgatgagcctgctttcaggtggagaaattgtaccattgctgaaaatagcttcgctgacagttagggcaagcttcattggtagcaagtttctatctggaaagatgtaggagaggaacactgactctggaagcagacgtgacctagttttgaaacctgggataaccacttcctatctgtatgacccgagcaagttactttccttctcagaactcctgttccacctctgtgcaatatggacagtactcctactttgcaaagttgttaaagatgggaactccagagtgcccagggaattgtctactcatcattgcaggcgtttaataacgtgtagccatttctggaatgggaggcaagaggatcgagttaccagtgaaattagtttggtattttcctagcttcctggttcccagatcctcaagaggctgccataatctctgtgaatttgtcctaaaatgacctgtataaataactgctttagacactggcttgtctttggtatgaaggaaaacattttagaatttttttggctggaggtcagtagctttcatccagaaaagaataatcaacggaaaaaaaaaaaaaccaccgagacgaggttatttttgttacagtcaaggaacaaaaagggatatattaaacttgggggaaaaagagaaggaaaactattattctttaaaaccgttataccatgcatcatggtaacatcttttttactgagagttctgcattagcacacttgttcacccaagtttgtgatagtttataggactgcctggtgtattaagtagaaatgctcaactttgctgtcctatttttttgatcatatccaaaaagtgtcagtgtttgaatatagttttattgccacttaaaaaggtaggacagttttattggcgtctactggacatggtaggaagagagctgtaatttgacacagattgtccttaacttgggtgacttaaggcaagtcacttaaccatctgagccttaatttcctcgtttgtaaattcaagagaataataacttctctgtcacatactgttttgtacagatcaagtaaaacaatgtgtgaaatgctgtaatgaagaagtccaatagtgtatgaatataaggttgctggcgtttggggaaaaatcatagttatagaagaaagactcctaaagggaagattagggttggaagaagatggaggaagagagtaatttaattccttaatggaaagaataaaataagagctcttgactttttttttttgttgttgttaggatatggggagaggtttctgcaaatatcttcttcagggtttacgaagtgaaccggatgtccggtaacagggttgcatgtcatgcaattgactgggtggtgatgactaaaattttaatgatgcgatctcatttaaagttgacaggctctgactctagccagatattcaggagcagaaacttgattcaataagaagggaacctgcagaggcagaaacttctgtgggttgcagttgtgttgagattacacaggtggaaatgttgcgagttcttgggtgatgcgatttcttcctgcttgccttaagtttcacctgcccaggtccttacttctgctcacagtgcagcacgaatttagatactgattggggattcagacacaaacgggatgctccttgcttatataacatcaacagaattgctggccacatcttgattatagaaactctttttcctggtgatcacacaaagcaaaagaatgaaaataatcaatctctttcaaatggagagactccgctgtgtcagccaccattggctataaggatgaactctcaaaactttttgtatcttgcaatataatgtcttccaactgcctttgattttactgtgtggctgtgtgatacagcaaggcagctgtggcttctaaattcagcagctaggtttgagaagcttctatcagctgagagatcatcagtacattccaaatggcattaaaaatgctgttacagctttatctattagcaaaggaagtttcaattctaagttcacgtacagttactagattgagtgtttgacaaggtagagagctctgtagtagatccatatggggaacatctcagtcagggtgtggagtcagatttttggcaagggataccatcctttcagcctgaaaagctgacttgggagctgtcagcctgtgtgcacgaggacctttttcctcccagggttagcgtcgccacttgcccagtgtttcttttttatttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggtgcttctatgctgcaaacctaagattataggcagtcataacacagtgttaagtatttgtgtatctaaacatagaaatggttcagtaaaaatacagtgttgtaatcttatgggactgccgttgtgtgtgcagtccattgtcatgtgatagtgattaagggaggtggacatttttgtgtttgcttatttccataagctcaagggtaaagcttcccaatcagcctttaggacagaggtaagaactggttggtggcctggagcctggatctggcctccagatgttttttgtatggaccacacaaaaatggtctatagtgggattttttttctttttttttttgtcagactacttgccagcatactaaaatcaggatattttacttaaatgtagatttatgacagttttgaaaaatcagaatgagtattgtagactaaatgtttatgtcttccccaaaaattcctatgttgaaaccctaatcttaaggtcatggtatttggacatggttgtgtccccactgaaatctcatcttgaactatagttcccatgatccccatgtcttgtgggagggacccggtgggagataattgaatcatgctgttctcacgataatgagtgagttctcatgagatctgatggttttataaggggctttcttcccttttgcttggcacttctcttactgctgtcatgtgaagaaggacgtgtttgcttcctctcctgccatgattgtaagtttcctgaggtctccccagccacgtggaactgtgagtcaattaaacctctttcctttataaatttcccagtcttcgatatgtccttatagcagcatgaaaacagactaatacaggggcctctgggaggtgattagatcatgagggtggagccctcataagtaagatttgtgccctgatgagaagaggatagaaaggtagctaactttccttaagctatgtgaatgtgagaacacagtgggaaggcagccatctgtaactagtaggagggccctccccaagaacgtgaccatgctgccaccttgaccttggactttaagcctccagaactgtgttaaagaaatgtctgctatttaagccactcggtccatgatattttgttgctgcagcttcagctgactatggcttatgtctatcaaggaacatagttgcactgaggttgaacagagctgttcctataggctgaccccctgtaggcaggcacaggctattttccatggtcagtttacctgcctgcttcctgtagaggcttgagcttggtttagagtctgcaatgaaaactgtgtgatgatattggactcactggctcatagccactgccacgcccttattcagtcttttgtgcaattaacaaacatttattgactactgagtaccaggtgctaagacttcagtgtagaaacaggcagggtccctgcccttgtggaggatacaaaacacaccaaaatgcagtcagcttcactgaatgacagagatatgatctgagaagtgtgtcaggcagtgtcatcgttgtgcaaccctcataggatgtacttacaaatcctacgtggtataacccattatacacagaggctgtatgggatagcctgttgcttccaggctgcaaacttgtatagcatggtaccgaactgaatactataggcagtcataacacaatggtaagtatttgtgtatctaaacacagaagtggtacagtaaaaatacagtgttgtaatcttatgggaccgccgttgtatctgcactccattgttgaccaatgtgttgttatgcagtgtgtgactgtaccagcagcttgatctttgtgcttctagagaacatttaaattgattcgcttttgtgagacagggtcttgctctgttacccaggcttcagtgcatcagcgtgatcatagctcactgtagcctctccctcctgggccaagtgatcctctcacctcagcctcctgagtagcttggactacaggcatgcaccaccattcctggctaatttcttttgtatttttaatagagatgaggtcttgctatgttgcccatgctggtcttgaactcgtgggctcaagcagtacacttgcctcagcctcccaaagtactgggattacaggtgtgagccaccacatctggcgaaactctgggtagtttctaattatttctgtatttctatttgtatttaaaagtacaggatactaaaatgttttttttttcttttttgagatggagtctcactctgtcgcccaggatggagtgcaatggcccgatcttggctcactgcaacctccacgtcccaggttcaagcgattctcctgcctcagcctcctgagtagctgggattacaggtgtgtgtgccaccacgcccagctattttttttgtatttttagtagagatggggtttcaccatgttggccaggacggtgttgaactcctgacctcgtgatcctcctacgtcggcctcccaaagtgctgggattacaggcgtgagccaccgcgcctggcaaggattttttttttttcatacttgaggaaacatctaacagcaaatatgttcttataagttaaaaagaacttttgctattttgaatgacactctcattaagtcttactactagtctctgatttttcttttttctttttctttttctttttttttttttttgagacagagtctcactctgtcgcccaggctggagtgcagtggtgctatcttggctcactgcaagctccacctcccgggttcacgccattctcctgcctcagcctcccgagtagctgggactacaggtgcccgccaccacgcccggctaatttttttgtattttttagtagagacggggtttcaccgtgttagcaaggatggtcttgatctcctgacctcgtgatctgcccacctcagcctcccaaagtgctgggattacaggcgtgagccaccacgcccggccttgatttttcttaacctttatttccaattatgcatcttctgagtaactataaagaaaagcaaaatctacagtaggtatggagtgagtgcagagtcaccatcagcttgaacaaatgtgtgtatctgtggtcaagtttaattgcttcttctgtaatttatattaatcacgcttccattgcttgccttttgttaatacgtatgcggccatgtgatgattttttaaaaggtcatccagtatcttgatgtccagtccatgcttataacctgagcagtttatgtactcttgagatggtatgtgctaaaaatgagtagctagtctgagtggcagccttacccattttattttgtgggcagatttcttttacagttctggctgggtttcttttagttggcttctttgctttgctcctgttacgacttagccctgtagctctgggctcttcgattctcacgtgctgatggtgtagctgagctctgctaatgctggttattaatctgacaatctataccagggaggttttataattgccataattcttatttgctccattccatttcccagcttctcaaatggggtggcagctgcaaagcacagtatttgaacatgaagtagagaatcgtcacttcagcttatgattttacattctgtcaaggctgcagggaaagcggtcatgtttctggatggtatttggatctacaaattccaagcaaactttttacttcttattatgtaaaatggaagggttagccaaattaagatctcaccatcaaccttgagggagtgacttctacatgccgtgtattactggttataaagctagtcttgtttggattgaagaatttaatcatatttaacttttcaaaggatgctttttaaaaaaccttatccgcgtgttatgtttaaactgagaagtacctgaaagtgaaaattttatttatttttactttttttgaaagatggagtcttgcactgtcacccaggcttgagtgcagtggctcaatctcggctcagtgcaaggtccacctcctgggtaaaggagattctcctgcttcagcttcccaactagctgggacaacaggtgtgtgccaccacgtccagctaatttttgtatttttattagagacggggtttcaccatgttggccaggctggtcttgaactcctaacctcaagtgatctgcccgccttggcctcccaaagtgctgggattacaggctcacgccaccatgcctagctgatttttgtatttttagtagagatggggtttcaccatgttggccaggctggtctggaactcctgacctcaggtgatccacccgcctcggcctcccaaagtagtggaatcacagacatgagccaccatgcctggcctgaaataatttcaaattaacccctgaggaacaaatgctcatgactttcaatgaatagaaaaatcagactgctagaacctccagactgcatgtcatgcgtagaagtagaatcctggggaagctagctcacaaaagcaagggagatacctgcaaggctgagctgagcttgcaagggaagaaaaatattagagagttgtcacatttagaaataagtgattccaaatttacagtcaatggactgtagatgccttccatcttcttaagagattttgtgcctcttgcacaggtattatccctaagatgtgttttcttcaatgtacctagactgtttccttaaagaattgcttttgtatggtacggctctatgtgtctgtgtttctcatgttggttaggagaactaacccttgtgacgaataagaaatggcaaacattgttaatgttgactttactagttgctcaaatattagcattggattttagagtcaacatgctagcaggatggctttattttaaaaccatgtgatagaaagctatctgctattattgatagcatttctggatggctgtcagaagtctttctttagaaatttaaccatatttttaatggtgggcattgcagtcaacaatagtacagactttgcaaagactatttttttttttgggtgcagtgaatacttcgcaatgcctgctgaattttacctattctgtaagtctttttgggaaccgttgagcccctcttctcttagttgcctttagcctttgtttttattatgacaattggtatgaaatttttccttttcattacttcttttattcagagcacacctctggcttatctcttcattctctgtttagtttcatattttactttaatttctgtacatcaatatctgccattatagtatttaagctcttggaaacatcaggcatttgttaacttgttgagaaaataaagcactccactgttgttatgagctgcttatggcaagtgaaaaactcacaatatttggccaaacttgggatcatttaggtgttgtttgcaattaatggcaggagatattttccttgttgttaagagtataacgttggttttagaaagcttgatctatgtttttctccatgttagatgtgaaaagaaccaggagagtgtgaggatattggtaatattgtcatatggtgatcccactgtggatagatacgcaagagagaaaatccagaagaaagcatttcactgaagcctggggacatttctggtgacaaatggtgctgatggcacagtgagaacgggagagggcagaagcaatgcacagatagaaagggtgtcacctgcgcattgaaaaatcccagtgccataacaatgcagtccctgcaatacagacaaacctgactcccaccattcctgtaaatgaagatggggccttgctgagaaatagaggatgcagattccaccctcaggcttcccgtcttgggatgcagagaaaactcacccacgtgcaacaactcaagagtcgttatttacctagcaaagtgttcacatgacagtgtttgaaatgtaccacgtgccttttcatgtttagtttagagcttgacactagagctctactgtggtttaccaagtgtgagggactatttctttctgagaaggaggggaagctttagtttccttgaatgtctaatagagtctgagtttccttttagaagcataaaagacgtacagtaggcagaatctggatttttaactatacagttgctgaagttatcttcaattcaaatcttctaaattcaattttgttaatgttgtttagatattattatagaagccagctttactgacttctgcacatttaatcataggagattcttccattctgtgaacttagatttcttttttctatccatgacatttatctaaatcaggctttcttttctttctactaaatttttcaattaccaataggctatgagaataattagactgacagtattactgaaaaaaaaacaaaacaacaacaacaaacaacaaaaaaaacaccttccactaaaactgactcaaaaagataatagcagggaaaatgacatgtcgatctgtgattccttttttacttgtcagtccttttgggagttgaacatataagcacatgtacctctatgtgacttttgagacgtctagaatagagaattcacctttgtagctggaatttattcagcatgcaaatgtgggtgggtgattgttttatagatgcctggtgttgaatgatgggcagttgtgataactatatataaaattatattaaagtccaagaggtgcttttatgaggcaggctggaaatggcatccgattttcttatggctttttcatgtccattttgatgaatctatttattacttctataatgagtagtacacatggttggttagccaagttattgaactttatcaaccttggctgaaattcacaatgcgtgccaaacttgttgtaacatgtaagaaattacatctgggctaaaaggttcaataatgattactcttataatggaatcttctacaaagcaagggatttcatgatatccctatgcttttaaaaaattattgtgatacagtgaaacaaggaagaacgtgtagctggaaaaatagtatttgcttgtaatatacattcagattcataacaggcttatttgattcccaggacagggtgagcaaaggatgctgtttcctgggtgtctgctttggtgttcattgagtcatgtctctctctttagaccttactggatctagtcttcatcatggggcctgtgagctctttcaaatctagaggacaaaacctaataaagtgctgtcatatcacatctgtttatgagtttcaaactgaaatgaaatgtgtagccgtgttattcttaaattacagagacttgaggaacgtagagctttttactctcactagagaaatctaagcacaggttggttcgttaacctgtaaagagatgtttgggttttaagaggtctatcaaataacacagtttccctttcccaagttactacctaactgagcagtaagaccacccattaggcaaatggaagaccaaaacatcacctgagtcattcatgaagctgatactggagaatatgtatagctgtgtgagctggtgggctttctaatcctgaccaccacaattagacagggtaatgggtcagtgctaggtcaggccagaccttcgcagagggcagaccccattcatgcagcatgttcaagacagtgcaggagagcagggtgtgtgctctctgtaagaggagaggagaggcagagctgcgtgtgcccggttctcaatcctggaattaccattcacataccattcacaacataagttggatcagctcccttgagcaggaataagtgagtggcagagggggtcagggatgttaacgcaaatggagatcccttcacccagaaagacacatctgaaatggagaagatgcctttttcctcctgcaaccaataagagagtgatgaaaattatgacgccttgggaaataagactgcaacgtaaatgtgtgtccaccccctagttttcttttggattgtgaatcctcaccctccgataactagacgtgctgttttgacgtctatgctttccagcttgccaattctggggcctggcacagtatctttcaccccggagtctcagtttcctcatctgtaaaatgggaaccatgacgtcagcatcacagagttgtgagaattcgacaaggtggaatgaaagcaactagtgtggtgtctgaccgcttgtgttagtccatgaggaatttccttacgtattgttttgtgtctaggaccaagttcttattttcttcttatggatgacttcatatatatgccgccacagagggaattaccgtttttctttgtaggtaaaaaggagctgggttaagatgcaccgtcatatgaaacagggaaaaagggtttgcttgggttttagattcctgaaacagtctgctgagggattctaaagttgttgtggtctctgttccactttgggagtttgataaaaattggcctgttttatttgacagctcttaggtagtgtgcaaaattgtcaacagataataaaagttttttgcaaagctatggctctatgtgctgtacttgagcagtatccatactcttaatagaattgatatatgaaagcaggtctttttccttatccgtttagacctaaatcttatccatagtgtgtggatatcacaaacagcacaagaggaagtgaaaggaacagagtgggtgagcaaaccattgttcaaaggaaacagaacctcgctcaaggaaaatgagaattcttctgatcagcttctataatggatgcaatgaggaaagttgtctagcagactgttcttggccaactgtctaaatggctcgctgcatcctcttcacgagagctgatggtaggactgtagaagagtcacaaaacatcacatgacaacgccagtccctctgataatcctgcaagagccagcccagttttgctgacagcacagtctgctgtttaattattgtgtgttcaatgacttacctctttttagtttaattaaaattatttctcagattaagagccatgctatgatgcttgccaacggatatttaaaacatgtaactgatttgttttttataatgcttcaggagaactcagttgagcagtaaagatgtgctcgtgatgtggttagctcagaataaggatgtgaaaaccaaaagggaaaggaggacaggagtgaatctggcacttatctttcagtggggcctgagtgcaaattcttcctaccttccatatgagagaatagggaaaattaaagaataaatgtctctgggtttaatgcaactttactaaggaatgaaagtccgataagaatccatatcttttgaaagaagattttttaaattccttatttttcctttctgcatggtcataaaacacactggggacagcccaccctgagaagtcaccaggcatctgcctgccttcagtagcaatcacccaactgctgtagaccgtaatcaagctttcaagaaccacgtgcagcacgctgcgggagagtcccagcgaagtgcttaatgcgccactccacggatgtgagtggggagcaagtgctcaaaatggggcttctgaattgcaatcatcatttggcatctctattacctacagctgctcaaagatgttccccccatgcaactgtttcttgcaactcctaacatttgcaacgaggcctctgatgcagacaacccgtttatacctctgggtggttgaaaccttcatggtttgttgtaaagaaaggtacacagtcccaccaatcagaccgtatctagaatattacgttcatttaggggtggcgcatagacaggctaaaggatggcaaagtcattgggtcatgtcctaggagcaacccttaaaggaagagtgaatggctggttagttggtagaagaaaagatttatgtaaattagttctctcagtagctatctaggagagagataatcctagctttcttcaagggacagaaccaggaccaatggacaaaatctgcaaggaggcagcatttaactgattagaattgtcgggggtggggttggcgagagggtgttgcttttctaatgattcacattgtataaaaagcagacagtaggtctggcactgttggctcatgcctgtaatcccagtactttgggaggccaaggcaggtgaatcatgaggtcaagggttcaagaccagcctggccaacatggtgaaaccccttctctactaaaaatacaaaaaattagttgggcgtactggcaggcgcctataatcccagctactcgggaggctgaggcaggagaattgcttgaacccaggaggcggaggttgcagcgagctgagattgcgccactgcactccagcccaggcgatagagtgagactctgtctctaaatacataaataaataaaagtagagagtaagttttctgtattgaaaatgttttaagagttctttgtcttaccttaggttcctccaaaaacagaaccagagaaaaagacatatttatgcataatttgggatgtgattacaaagagagggatggggaattcaggaaggaaggagaggcaatataaaaatgtgttttttagttagtcattactagaggcaactagtgctcaactccaggcactttaggaaatgcatctcatagctgtctgcctgcggaataaagggcatttatccaccggcttctgaccccgttggacaagggcgtcccataagttttgatgtcccagaattttgggtttgcacatgtgcaagtgccaagcaggttcttgtaggcatcccatgctgcagagtcagagaatctctaggatggaaatggggggatccatattgtagccccaggtgaggccatctggttgcatttgtgtcaagttggttgaaaactgcatggtgagcgtaaaaatggtttgagtaaaatggagctgtgagaatttgaaggggtgcatgagaggtgcccgatacagtccaccccctgcaccatgctcaggtctcttaagagtaagcagaatctaccacagtgtatccttaaagttaaaaggctctctgatgggactataaatgagtcccagtttgatgaattctggggctttagccttttctgctgtggtattagttttctggggctgctgtagcaaagtaccataaactgggtggcttgggacaacagaaatttattgtttccaagttctagaggctagaagtctgaaatcaaggtgttggtagggccatactccctttaaaatgtgtagggaaggacccttccttgcctctttcagcttctggtagccctagatgttcattggcctgtggcagggtaattccagtctctgcctccatctgcacaagccattctccctgtatcttttcacatcatcttccctctattactgtttgtctctgttttctgatctcctcttcttctaagggtgacagttttactgggtgagagcccaccttaatgccctcagtttaactcgatgacctctgcaaaggccctgtttccaagtaaggtgacattctgaggtactgggcttaggacttcaacatatctttttggggggacacaattagaccaatagcaactgtgctataaaagagatgttgctttttatcattgatgctatccagatgcatagcaatcattcaacaagtcattcgaaagaaataggtatttcctgagggtctagtatgtaactcagctctgctctaggacctggtgattacagcagtgaacaaagtgctcctgcctacgtgcagcttactttcttatggagcatgattttcagaagtaattgttcttttgcctcgttatcatcagacattaggaaccaaggggggattgcctgcttttggatcacagagcaagctgccttgagcaagtgagttcgaattgcaaaggtgtttaagcatagcttggtggctgcttagtgaggatgttgcagaggcaatttaaatgccgagcagggctttgggtttgtgatggttaaagtccatttccactgcggagatggtatgattgtacaaatggacaggttctgggcctctgtctgttttgtcaagtatacaacacttctgtttatctttaaagggaacaaatagtgttttcacaggtctctgcttaaataaaaagattctagaccactggatgtcaaccccaccatcccccttctttttttttttttttttttgcatcctgtactcctttgagaatatagtggaacctctggcccattctacaagggaaaaataaatgtattcctagccaggcatttgtgtacaattttgtaggggaggaaaggattgttcatagacactgaattaagaaatccctacactttatgggaattgtaatcattagtagcagttacgtagacatacttccattaaatacacatacttgctttagagagtgtgtttattcataaaaattcattgaataggattaggaataaaaatatgcatagaaatatttgttactttttcattgtaatggttttttttggatagaaatttatcagtgtgtaattaataaagtagtattgatttcagaattatacggtgctaaacaatggaaatttcctaaataactggcaggtaatggaaaaaaaattcagttactgacagcctgtcatagttgaatctaagagctaggggcaaaatacatatattctatgtagtttccatttctagaccctggatttctaaattcttccttataaaattttaaatttctttttttttttttttaaagatggtgctccctaactgatttccttcattttattatctcataacagatttgattttcacaatgaaggtaattattaaaatgcttcctttggtagtcaataaatataattagtttaagaaaactagaaatatttgttattagaattaggtgaacatctaagagtcttatttatggaagcaacatggtcaatatttatggaattgagttgaggctttgcaacactttcaacagctttttaaaaagcaaaatagttactgcctctgtggaaatagaaattacccacctattatgtaatgaaaaactaatgttggtttacttaaaacaaaactgtgtagcagtgtgttatagccacaggaactcctcagccaaatgttaagttaatgcaatgaaaacatttgtaaaaacattatcaagctgcaaaagaactagaaatgctagatactccctagtagctgggtgttcaaaaacacttgtcattctcacagttatatttgtggtatcttagtggtcattcaccttggatgtgattcctcaagtatgccagaaaagcatcgtcttgtgcaagtgttgtatttaggaagaactttgtgtgaaatcatgattgtgggtgaataactttaaataaataaatcgttttccttgatatacaatattgtgctactttccacagaaagatggaatcaatgctcttgactgtaatggaggtttacagtttttctaatttcttatttaggctgatctgagcaaagatgttcaaatttccacttatttaaacaagatagagtttttgctatgttgaaggaatatttttagcttagtaatttacttagaaactgccttattcaatattcgatgttaaatttgaactaaaacacatagcatcatatgacatggagtcttacattcacattttgttggactggaaacagaatcaacatattagtcatcttaattcatttaagttggctttctccagaattctagaatccaaaaacaacacatttgtcagttttacacacaaaaggagaggcaggatgtagtttatagttaaacatccagctttgcaatgaaaagccaatgtagctatagcacactgaatgaaattctgggtgaaacaaactgtgtaataagattttgatgcatattgaatacttagaaaatttgttttatatttgttttaatgagattctctttatatctgctttcatagaaacttgtaaattgtctaaaattaaattttctgtggttgtcatccacatgggttctgaacttgctgttataattattcacattttcttgcagtgaaaatctacagatcaaggtcatcttcacgtctttagttcttgttttgcttcaggtcagtttagaaccgaatgttaaaaggatattgtctattcgaagggtcagattgtggcacgtggaccaaatccagccccccgaggcccacttttgtaaatcaggttttattggaacacgggtgctcatcgtttacatatcgcccatggctgctttcacatcataacagcagaattgagtagctgtgagaccctatggccagcaaagcccaagatatttactgcatttatttactgtatttatgtttattctcttgccctttacagaaaaagtttggcaacccctggtttattctgttaacatgtttcctatataaggattcctctaataagttttcagaattattaagaaaacaaagctcattcctctaaaagaattggtatgtttttttttttttttttttggtggtggttgtttaatgaggaggacattataaagtattatatttcgtttccttaccttggttgccaggaagctcagaactttaaacattaaaatgtttaagtaaccagctcacttcacgtttcggatcagctttctttttcttaacacggggatacattttcactttaaaaaaaaatcaactttttgaagcataatttacatgttgtaaaacccatacatttaaatcatacacatgaaggtcttgacaagtgtgtacacacacataaaccaccaccccagtcaagataatagaatattcacatctgtaagaaattttccacctgccccttggctcaggcaatttgtcagtcttactactgattattgcgttattttaaaaccctgggttgtatgcaattgtctattacaagctgttttaaatagttttcggtagtggctggggcactaatgattaatagttgaatagcacagctggagaagttaagattcatttattctatttagtcttcagtacaaatttttaggtttccatgggagaatctgagatacagctcacatggagagccttttagctaatgtagcaataattaataagctggatagcctgatagcctgatgttttattagggtggtgcaaacgtggtttttgccattactatatatatatatatatacacatatatatatatacacacatatatatatatatatatacacacacacacacatatatatatatatatatatatatttttttttttttttggagatggagttttactctgtcgcccaggctggagtacagtggcgcgatctgagctcactgcaacctctgcctcccaggttcaagcaattctcctgcctcagcctcccaatagctgggattacaggtgcacgctaccatgcccggctgatttttgtatttttagtagaggtggggttttgctgtattggccaggccagtctcaaactcctgacctcaagaaatccgcccaccttggcctaccaaagtgctgggattacaggcgtgagccaccgtgcctggcctgccgttacttttaatggcaaagataattcttttaataattaaaatttgaaataattcttttaataagaatttgctgcttgccaagagctctgcagttattttattcaattttcctaacagctcttaagagtacatcttattattcccctttcacagatgaggaaattgaggttcacagaagttaagtctattagtttgctagagctgctgtaacaaagcaccacaaattgggtagcttaaacaacaaaatttattgtctcatagttctgtaggccagaaggttgaagtcaaggtgttggcagggttggttccttctgaggactgggaggagatacctgttacaggcctctctccttggcttgtagatgagtgtattagggttctctagaggggcagaataggataggtgcattaatatttatgaaggggagtttattaaggagtattgactcccacaatcacaagctgagggacaaggaagccagtttgagtcctcaaacctcaaaaatagagaagccgatagtgtagccttcaggctgtggtcaaaggccccaagagcccctggcaaaccactggtgtaagtccaagagtccaaaagctgaagaacttggagtccgatgttccagggcaggaaggatccagcatgggagaaagataaaggccggaagactcagcaagtgtgttgttccatcttctcctgcctgcttttctcttggctcgctggcagctgattagatggtaccaacccaaattgagggtgggtctgtctctcttcatccgctgacttaaatgttaacctcctttggaaacacccgcacagacacacccaggaacagcaccttgcatccttcaatccaatcacattgacactcaatattaaccatctcagtaggcttcttcgtgttcacatagtctcctcaccgtgtgctgtgtccagatttccccttttcataaggacaccagtcctattggattagggctcccccattatgacctcatttatccttaattatgaccataaaggccccatctccagatgcagtcatgttgggggttagggcttcagtgtatgagtttgggatggcaggggagcagttcagctcgtgagaatcgtaagattcctgatctgtttctcttccaagaaattgtttggtttcatgttgattttatctccttttccctatctgtctcaaagcactgaagaaaatcaagtcccccttgccctgataaggactttaaaatggtgtttgctaaaatggtgtgtgcttaggggcagctttgagccagataacaattctagttgcgcatgcttccataagctgtttactctaggaaggagaatctctgttgggatcttttggggagtacttgcctcccaagtgcttaggctcccgctgctgacaagaccctctgcctggcaagccgtgcaggttggaatcctctgttagggttccaaagccttcaccaactcagagctctttctctctctgtttctcttttttgaatttaaattgatcctagtcacaatgttcacattacctatgttggggatcctaccaagaccctctttttggcccagaagcagcagcggggtgaggggaatgaaacaaaaatttatagctgtcgagtctccagaagtcatgtaaaatcagcctcagctggaagctcctccgtgcatccctcacattcacacaagcaggtgcctgatcacagctgatggttagattacacgtttcctgagaggtatagatttcaaaattggtgtatttcacccgtccctcatcatggtatccccaaacaaaatgttatcaaatgaagaactccttcccagctctcccttctgagtgtctgattttattcaagctcagatggcttctcagatagcgtaaaaagtgatggagaatttcttttaccaattgtatgccctgtgggaacctgggtgctgtaatcactgaatatgttataaccaaaaaggtcaaactcgcaatgattcggtgtgttttgttccgtgcatcctggcatgtgaaagaagtgaggtaaagagtataatttacttccttgttttaaagctagcattgcccgtgccttccacgcgggactgttgtggatatttgaccactgcaagaaaactcacagaagcagaaacttagggcttgctttaaatgttatcagtgtgaattgagatggtgtcagcattatttttttaaagaccaaaacaacaatagtaacaaacacacacaagccactgttagattttacaaaactttaaaaagtaattatcttaaagatatctaagatagtgatctggttacatagattatcagagatacttttttttttgattatcagagatacttttaaaaaagcaactacaaggtaaggattatcctttaatttagtgtttttctattaaactcaatttgctttaaagttttttacattttgcctcttttttgtatgtttgagtaccacttcctaaccaatcacaataaatgtccggtttggagttggaggagtcattgattttaggcaaggtgatggtgagcccacagagcacagagttaatggaactctggccgttgatgtagcttcgaagcctgaatttaagtcatatttttgaaaagttgcgtcttaaaaagttactagcgatggagaatgaaaagtcaatttggacactttaaaagtgagcctcaaaaaactgctgaattttcccaacattgtgttttgagcacttccacgtgactttggtagcataaagactttagtcttttcaagaggcaaagtaatataccacttttcgcttttttaatggtgagagccaaggtcaatctgaatttttctttttctttcttcctttttttttttttttttttttaaaaaaaaaaaaggtgcttgaattagaaaggtagcacattgtccacatggacagtgcaggatggggctggctttttcatttctgagagctggcaatggaatgaaggtctttttttttttttcttaatttttcttttttaaacaattccctcctaagcatttcttaattgacaggggtggaaactatgttgccaagagggatcacagcccttttggtcattaagaaagtcaaggaacggggtctctttggatgagtgtgtgcgtgtagaatcctggtggctggcctgcttgctctaaatcataaagaaccctgtctcgagcagacgagaaagagtaacggaggcctcaatggtgaaaggaaatcctgtaccagctgtgaaaacaatgagacacgttcagtaatagaatatagtgtgcttacaaattcagagttgggttcccttcttctcttgaagtggctataaattaattcatcaaaataaaaaaggccaaacttcaggataaatctttctacttctaaacaaccagaaacactttggttgtcttagtagataggagtgtgagtacagaattatacgaagtgagaccatgggtgtgtgtgtgcacgtgtgtgcgcatgcctgtgtgtgtcattggttagttaacaaaaggattgccctctgaagaacatgaacttgggccagacagcacgtgtagggggtggaattatggagcaattgttactttcttgtattaagaagaaagggagcaaaagagctgtgtcttcttgagaacctttaaaagacacagaggtctctgcctctaaaaagctccattacatttttttttttaacaggaggcctaaattttttatgttttattttgtgctgttttatttttcttcctaaggttctcagacaagtttataaaagtgccatgttggctgggcagagtggctcacgcctgtaatcccagcactttgggagaccagggtgggtagatcacgaggtcaggagatcgagaccatcctggctaacacggtgaaaccccgtctctactaaaaataacacaaaattagctgggcatggtggcgggcgcctgtagtcccagctactcgggaggctgaggcaggagaatggcgtgaacctgggaggcggagcttgcagtgagccgagattgcgccactgcactccagcctgggcgacagagcaagactccgtctcaaaaaaaaaaaaaaaaaaaaaaaaaaaagtgccatgtatattttgattacaaaaaatttcatgcggtgttactttctttttattggtagagggtctttatgttttatttttttgagacagaatctgctccatcactcaggctggagggcagtggcaggatcgtagctcactgtaacctcgaattcctaagctcaagtgatcctcctgccttggcctcctaaagtgctgggattatactttgagccactgtgcctggctggcctttgtgttggacgttaatacagttggttctttaaagtttgacagtgaagacttttggaaattaaagaaaaaaaattgagtataacttgtaacggtcatggtgtaaagatcattttttactggttggaagtatagaagtggggttaaattaagtctataattgtaaactattgatgttggaagaacatagagagaaacttattcctgtggactggtgatcccatctcacagcccttacagataaatgtttgtaaaagcaaaggacagtgttaattctgagccccaagatgaaatatcaagtaaaagagaagaacatttgccaatgcatcactgtctgggaatggattccatacagcaggtaggtttatgtaatacagtagctgaagagacctcaattctgtgccttgatgggattacaccgaagggagcactggtaggctgttgatgaaacaggtggtatttggaccacttctccctctttccggacagctgcttagtaggtttagcttaaattatacacatgccaagcatgtacacatatgagaagcctatatctcgtaatatccacagagaatagatggcaaatcccatgatttgtatttgactgacagtcaagaccctgtggggtgtgagcctggtgggggcattccaggctggtttctcctgcctccaggagctgcttctagtgtgtgctcttaaccctaaaggaaggaaacactgtgtcttcctcttctctcatacagagcccttcccatgacaaatgtgtggagtgttccctccttttacgtaattctccaattttctggaccccagcttggtgtcctacaattcagttttgacactaacgacccagagtcagcacagaccccatggttgagggctcagtcctacaggatcatcccctacttcaaatgccagtagcaagttcaagattgtcaagtgcacttctgactcactggctacaaattggggttcccacgaccatctcctcaggcttgataatttgctataatggctcataaaactcagggaaatatttacttatgtttacctgtttatgataaaggatattacaaagagtacagatgaagcggtacatagggccaggcatgcggaggggatgtggagcttccataccccctcccggcatgcccctctccaggcaccacatgctcagcaatctggaagctctccaaaccctatcgtttaggtttttgttgttgttgttttgagatagggtctcgctctgttgcccaggctgcagtgcagtggtgcaattatgcaatcatggctcattacagccaggacctcccaggctaaagccatcctcctgcctcagcttcctgagtagctgggactacagttgcacaccaccatgcctggctaagtttttttgttttgtttattagagacgaggtctcaatatgtcacccaggctggtcttgaactcctcagctcaagcaatcctcctgcctcggcctcccaaagtgctgagattacaggtgtgagccactgtgcctctccatttaggattcttagagaggttttgttaccctaggcatgattacttaaatcattggccattggtgattaagtcaatctccagcccctcctcttcccccaaggcggggaatgtgggggttatcaattattcacaactctctaattgtgaataataaaagactctcccctcacccacattgctcagaaaatttcaaaggtttttgtttttttagacagggtctcgctctgtcacccacccaggctggagtgtagtggtgcagtcatagctcactgcagcctccaacttctgggctcaagtgatcctcccacctcagcctcttgagtaactgggactgcaggtgcatggcactgtgctccacaattttttttttttttttagagatgggatctcactgtgttgtccaggctggtctcaaacccttgggtttaagtgatcctcttgcctcagcttcccaatgtgctaggattacaggcatgagaccccatgcctggccaatttcaaggattttaggagctctgtgccaggaacctggatgaagacccagtatgtatttcttattatatcacaatatcacaaatccacagtcacatggtgattgtggtagtgtggggggcctgatggtggggtacacctgcttgaagtcaggctaccatgcccattggggtcctcccccttttttgccctctgatcttgtgagttccttaacattggggatcagtggtttttctcttacatgaaatgacaatgacactttatagggtttctgtagagaataccttagaattagttaatgtgtttcataaagcacatggcgtggtacccagccaagagtaacactctgaagtgctcctccttacctggacattacagcatcctttgtataaatcaggatgctcaggaaataccttgtttggaataggaataggctcctccctttttttctcacttgccttgattgctctgtattaaaattcataaaggcccatgaattatcaattagatagcatttggtttgttatttttagtttcttcctatagcaggcatgtatgcatgtgttaaaaatggaagtagcgtcgacattatgaaatgcacaagaagttttcctgcccccaaccggtaactctctcctgcagtaatcaatgttggcacctgtttaaccacttttgtgtcttacgtgcacgctgttcggtactttgactttttttcttaatattataacatggaggccaggcgcggtggctcacgcctgtaatcccagcactttgggaggccgaggcgggcagatcacgaggtcaggagatggagaccgtcctggctaacacggtgaaaccccgtctctactaaaaatacaaaaaattagccgggtgtggtggcgggcgcctgtagtcccagctactcgggaggctgaggcaggagagtggcgtgaacccgggaggcggagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttatataacctaattgataaaacattttggttgattgcagtctgtcgtagataatgccgtactgaatattcctcccacatatttgcaagtctatttgtaggataaatttctggttgtggctgggtcaaagagcatgtccacttcaaatttgatagctatgtcccaactgcccccaaatatgttaagccatttcctatcccccatccctcattaatctatgaagttgcctggttgccccacatctttaccgacaggactgccgctcaatgtagttacccttgtagaatctgtctgcatgtgcctgtctaggaccatgttaattgtaatctttgggcatttttctcactcattcctaaccaggactgtcactggcaggttaaatgagaacttattcacccagcacagtggcagcactagtagccagcctggggtcagtcttgcctctcgagagatctcatgcagtcaactgggatttattgtacagctttacaaaacattacggcctcagccttgtactgcccaaagcatgcagatgccgcctggtgtattttaaagatattccacatgaactgacccgtttcccacttcttgagttggtatgttttttgattaatatatttgagatgtatttatgttattagggctatttaggaagctctgtagggatttgttgcttgctgtatataacacatacttttaaaaagcagggctggctatgacttatttttctctagagagacctgtgtagttttgtaagttcttaagatttggcagctgtggatcgtgtttagtaagcacgatctctaactctttggaactcagaactatgtaattgaaatggcctgggaggcaaatgtgatcattcaggtaatcaaagtaactacagaaacagaggtatggattagctagtcattgcagatgtggcattgagcatataggcgtggtgtacttcttagaacttcatctggaaatgcctgtgggggagttggatttcaagatcatcgtcaatgtcatgtcactgtaatttcatttacattaatcagattagtttggaaagtatggtcttcctacttttaggaggatataggagaaactcatccttaaagatagtagtctgttaatacaaaaacagtccccacatttgcattgtccccaaatctaacccaagctgaaagacattaggcctatcttcttgctttatgcataatggcagatctccagggagggagaggatgtgtgctggaagattctacaacttgttgattggttcctaaagatcgttttagtgctatgtttgtggggcggggctggagggggctggaaatcaccatctctgtggccttttaattgtgcccagttacaagtaacatttgtccccagtgtttcacaattataaattaataataaccacccattagaaattacgggtattgtaagccccaactcctttgggcgtcttaataaaaatgataattaaaaccataatttacagtaaatggggacactgcccaagtacatccacaatatggagaaaattaaaaaacttaaaccagaaggaaccttcctggcatcggggaaagaagctgcctttttcttagctcctacctctgtgggagctttgtcagtatttgaggggacagggttcccaccttcatgttttttgtgcctgaggattctgtgggcgactgtccccacctgtccaacctaccagtgagtctcatggtgtgcggctgcctgctccgatgctctccaccaccatgcccaagccatttctccctttgtgttccctgtctgggtaaacaacttgccaagctcaccagtggcccacagggcaccttggacacctagacttaggcagtccctggctttgtagattttttttgcttcctacatgattttctaatttataccttgagctgctcgggataagagggcacctcgtccatttctggctggtcacaaggccacagtatcttgagcgagtccattgtgaccactggaggtactgtaaatggataaaataataatatgaataataactcatagtgtttactccctgcctaaatccacaggctcccgctgcctacagaggagtcccacagttttcgcttgcttcatggagcttcatctctgttgtattcatgtgatttatttacacagagttgctccccaatccttgatctttttttttttttttttttttttttgccaagcaccctgcctttttgcttgtctgtttcgtctttatctctccttccagtaaagttcttggcccagaggttctgctgccactcagtgacatttgtgaaatgcaagggagcttgcaccatgggttcaagctcctgcagatccctgagcctgctacccttgtgcttctctgtccacgcaaagccaagtgctactgcggggttttccaaggcatagctagcatcctaatagtctcacacttgacatagtagggtttgacatggtttaaataaaatctcaaccagatcagtgggagatgttctttgagattcggtgattgagttgtgaacgtatggactgagggtgttttgtggtaaggcttgagtcatgtctgtagcaaggatgtttcctgaataatgtgcactgagcatcaagtgcctgcagtggcctggcgggtaatgccagcagcacgggtgatgatcatggtcaacatgaccaactagaaagcccaaaccccacctctagctgacagtggcttctcagctaacctgtcaccacgtgggattgggcccccagtggtgtaagctttttcagagaagctacacatctagcttttggacctgtgatctccccaatgttttaatgctggcaactaattcaaattaggaaggaaggaaggaagagaggttggaagggagagagagaaagaaggagcaaaggagaaaagaaaggagagaaggaggaagggagggaggaaggaaggaaagaaaaggaaggaagggaaagggaaggaaggaagggaagggaagaaagtatgggccacacaaaacaggtctgtgggcttgacttgtcctctgatcatcagtttgtgacctctgttctaaagagtgaaaactatgtaagatagtataagataagtaggtatttaaattactttgcaccttttccatttcatagaacttgaatgtttgtgttcaaagcttaaaacccaagacagtgagctattaagcctccatggccacgtcatttttctgattgcatctgatgtaacaagtgctagaaaaactgatgctgttcattgctttaaaacgtctttctttattttcttggtattattaggtttacatattcttccgaacacactcttgccatctccatgcagttaagctagttcaatttaaacattgtcataaagttaattttttataagatgaatcaggttattaaatttagtaaaccattgccttcattattttgcacaaactttggcactgtgcagaataggcttagcactactacatttagctaattaaactggccgtcagctgcagtattacaagagtgagggatgttattctcttgggttttatccaggactttaacagtaggtagcattattaagctttttttatataaaactccacactctagagatatggtttactataaaagtgttattgtccttcctgttaaactatcatcttttgaaatagccacgctttgtttctgttccaaaggcaattgtaaagggtaagaaaatggagttgtctattgcagcttttaaaagtagactagcaacgggtaatgcattgcttagataaaggaagatgtaagaaccagagtgtaatttcacaagacacagagacagatggcttacccgtaactacagtcaggaattctctaaaggagagagggtggaagcttgagcctgtagcctgttgctgctgtcttgtcagatgtgccctttctggtaataaaaagtcctttgccgtgggttattttgtcaagtgagatagcaggacttaacaggtttgtttgggaaaataaaatttgatagaaaaacggcgtgcttttcccccacagatttcttggtagcatcattcaaaactacagtgagcagtatctttgcaggattttaatatttattcattattataaaggaaggaagagggccatcgtgttgcagtttgaaacagcctggattgttttaaaatagtccagagctgcagcctattagcagtctgcaagaaccatttgtttcttcagcagatatttattgaatcctactgggtgctagtctggcgaaatacggagattggagggtgtaaggctcaaggagcttacctgagaaactggataaataaagctctgtactgggtgtggtggctcacgcctgtaatcccagcactttgggaggtcgaggtgggtgggtcatttgaggttaggagttcgagagcagcctggccaacatggtgaaatcccgtctctactaaaaatacaaaaattagctgggtgtggtggcacgcgcctgtaatcccagttgctggggagactgagacacgagaatcgcttgaatccctgcggtggaggttctagtgagcagaggttgcagattgcaccgctgcactccagcccgggtgacagagtgagactctgtctcagtcagtcaatcagtcaatcaatcaagttctggaacctgcctggccttgtgttatatcgatgctttctcaatctgttaaaaacgtagctgctattgaatgactaagaattgtttactctcatttccactctcttacatcttttttttttcttttaataccctgtgatgaaactgtgaagaaagatattcctgatcattgctttgacctggaaatttcaaagggacccacagtccaccattccgtccaagatcttctgggtgtgtgaagtcccgggctcccaaatgcagttgtgtttggtcactgtgttgcttgcatatggctgttggcatctcattagcctgattgatggggcagatcagtcagcaagactttgttcggtgcctgcccccagccagctgggctacaaaacctggcattttacttctctcattttccccaaatgatctaggtgtcttttgctcactggtgataaggggtgacattggtatcacaggtaaaaatgagtaaatttgagattattgtcgtcttgctttaaaggttggagatacagcttcaaaaaccttttactacccacacacccaaggggagtcaaatggatttaggtgttaaatacttcaggtttgaaatcctttgtgcattatttcagcatctgatttaagtatcagaggtcatctttaggtaataagtaagtattttggaatatgggatttggcaaaatctcaagaaataatttcaggttgtctcagcaatgaggttaaattgtgctccagagtccatattcagacaaacggaatggtggagcccgaggttgatttctttgaattctggttggtattaaagtcattcagccctcgggttaccattggtagcacatctaggagcaagttttaattttttagtcatagtgactgtgctggatttggtaggtcgtacgaattgggtaagaggcataggacaccaaggattttgcaaaaagcaggcaactaacatttgttttccacctactatgattatgttaggctctcaatatatgtttaccacttattccccattttacagaaacgataactgagtttcacatgggttcaaggcgtgaccttagatcccacagcttgtacgtgcttagaactggcagcaacacaagtgtgtccaacttgagttttcctctgtgctatgctgattttccttgagaagtattctgtataaatagactgttttctatgaagattaggcctgtgggagtgatatgaatgaatgaactttactaggctctttcacatggtgatgtcaggaagataacggtatgctgattttgcgtgcatattaacattatcttgtaaacaataatttatggccatttgacatgggtttggctgaattgcatagctgccttctctagtagaattgactactttgttattgtactgtactctatagggtcttccaccacagattacaaaatatggtattttttagtttagagcaatgggttggtgttcaagctctggattagactgcctcttctttttcctccctccctcccctcccctcctctcctttccccttttttgagatgactttaaaatatagattcatattttttaaatatacagaactttttcagttttccatttcttcttgtggcaactttttttgtagtgtttttctaggaatttgtcttttttacctgtattgtaaattcattggtataaagttgttcaccatatcttaagatcttctttgggttcataggatctgtagtccttttctttatttttcatttttaaaaacaactttattgaggtatgattgatgtacaaaaagccttacgtatttgatgtatagaacttgataagtttggagataagtatatacctgtgaaaccattatattttataagtacatgatacaatatgagcacagtactatatggtagatctctagggcttttccatctggcgtacctgaaacttcataccctttggctaatacctccttgtttctctctcccctcagccctttgcctacaccattctattttttgcctctatgagtttgagtgtcttagattcctcatataaattgtatcatgtagtatttgtccttctgtgtctggcttatttcacttagcataatgtccttcaggttcatccatgttgttgcaaatagcagaatttccttcattcctaaggctgaataatattccattgtgtgtgtttgtgtgtgtgtgtgtttgtgtgtgtgtcttccacatttcctttatccattcattcatcagtagaaatttaggctgcttccatgtcttggctagtatgaataatgctgcagtgaacatgagagggcagacatattgttgtgatcctgatttgagttcctttggatatgtatccagaagtaggattgctggatcataatccagcaatttttaattcttgtttcgttttttgaggaacctccatactgtttttcataatggttgcaccaatttacattccactaaggaatgtaagtttctcacgcataagggggctcttgtttccacaccctgaaccacacttgttatctttcattttatgatgagaaccaccttaagaggtgtgaggtgacatctcactgtggtttcaatttgcattttcctgagaattagtgacagtgagccccttttcatacacttggctatttgtatgttttctttggagaattgtctatttggttcctttgcttgtttttaaaatctgtggtttttttttttttttttttttttgctattgggttttaggagttccttatatattttggatatgaacactatcagttatgaggtttgcaagtattttttactattttgtagcttgccctttcagtgtcttgattgttttctttaacgtgcagaagctttttagttttacgtaacctcacttgtctagttttgcttttgttgcttatgcttttatgtggcataatgttgtccttttattcatccctgatattggttgttcaagccctctctttctgtctctgtctctctctctgtcattcttgctagccctttatcaattttattagttttttcaattgacagacttttagcttctttttttctctgtattttatgtttgttttagatttataagtttctcctttctccttttatttccatcgttctgctttctttaggcttaatttgctgggttattttcctaatgtaatggatgcttagatcatcttggatgcttagatcatcattttttctttctttctttttttttggagcaagatctcactctgtcacccaggctggagtgaagtggcatgatcatcctcctgagtagctgggaccacaggtgtgcaccaccacgcccaactaattttttgtagagatggaattttgccatgttgcccaggctggtctcgaactcttgggctcaagcgatccacccgcctcggccaccccgattcctgggattacagccatgagccactgtgcctggtcttctttttaatatatgtagttaaggctatagattttcttttaaccatggctttagctatactccttaagtttgtatatgtgtttgtaattaccgagtttaaaatatttctaactttcattgtaattttttgagccataatgtcttatttatttatacatatatttccagaaatgagaattttctgggatcttgttattgatttgtaatttaattccattgcggtcaaagagcatactttctaattttaatcttttgaaattcattgagacttgcttttgcccctgcaaatcatcagttttggtaagtattcttgaagtacttgagtatattttgctgttgctttcagtgtttatcatattcaattattttcagtttatcaattaagttgttcaagtcttctatatactttgtgtttgtctgcttattttatctgttactaagagggatatgttaaaatcttccattataattgtgaatttgtctatttattgtcctaattctgtcaatttttgacatatatgagaggctctattattaagtacatataaatttagaattgtcatgtattcttggtggattgaaatttaccattgtgaaatattcagcactttctcttgtaatgcttcttgctttagagtcttttttttctgaaattagtacagctatatcagatttcttttggcccgtgttatacagtataccttttctattcttttactttttttatgcttatgtttaaataaggtataaaacataatgtacattcttttttaaggacagtatatgtatatttatgttttcttcagtctgacaaactttttcttttaattgccatctttaggccatttatatttaatgtaatgacagatatatttgagtttgggtttaaatataccaccttattattggcttcctgttaagttattctatattcctctttcccttatttctatcctttctttctcttttttcttttcctttttcctttctctctctctctctctttctttctctttcctttctttcttccatttaaattgagacagggccttgctctgtcactctggctggagtgcagtggcataatcatagctgactgtgcccttgaactcttggactcaggcaatccctcgacatcagccttctgagtagctgggactaccggtacctgccaccacacctggctatttcttttttaattttaatttttgtagagacagagttttgctatgttgcccaagctggtcacaagtgatcctcatgctttggccgcccacggtgctagaattacaggccactgtacctagtcatcttctctcctttcttgcctttttatcattctgcttttcttctccattagctttttaaatttgtagagatttacatcttgcatctttgacttattaaaatctaatataaatcagtattatatcacttcctggagaagacaagaaccttaggatactttgcttccattactcacctcctaggttaagcattgttattattattgatatagtaatttttgctatatattttaaaactcacagatttcactcttaccatttggatcttaacatgtcgttaccctttatgttgctctttgttactttctgcatctctgggtttatagctaaggtcattttcctcctgcctgaagagcatcctttagtgtttcctctagtgtgggtctatacgtgacactaggtgtagtgtaggtgacaaacaaaaagcagctttcgtttgcttaaaatttttgttctctgcctttatttttcaaaaatattttcactaggtatagaattctaagatgaaagttttattttttttcagctgtggcttccatcattttcctgagaggtataactatcagtcttgtagctactggtctctaactacttctaaaactatctgcagtttttagcagttttactctgatgtgccttgctttgacatgtatgtgtatatatgtgtatctacacacacatacacacatacagatacacactcacatatatatttctgtttgcggctcacacagacataaatatatatatatatacaaacgtacatttctgcttgtagcttgcacatatatatatacacacacacacatacatgtagacacacacatttatacatatacatgtcaacacatacacatacatatttctgcttatggctcaggatacttctttttttggccgtgtatgcgtcattgattttgtaacattatcagccattctgtctttaaatattgcttttcttagtctatttcacttgttttggaactcagattacatgtatgtgtaagagcctgggagaatgtgtttcatatgtctcttttgtgctttgttttattgtgttatttttttctttttatgcttcactttggatttttttgttaacttattttgtagtttcctcaatcttgtcgtcagctgtgtcttgtattctgttaaactatatgctgaattcttctttactcttattactcttattttgtttaagtttcagaatatctatttgaatttttttattgtttctaattccctggcaaaattctccatcttgcctttttgttccttgaatttgtcagtcagacttattttaatcactgtttctgaataacttgattagacagatctcctgtgcatttatttccatttgttcccctctggcttttggtgaagttttttctttttgtatgcttagctattttgtttgaatgtctgagagtttatatgagtatttgaaataatcatagtggtaatttgagactctagataatggtatcttcctccagagaacattttctcttgcttctggaaattggatagatagggactgatcactttaatcaaactaggaattgaaatggcctgaagctgagtttccactcttgtgaaggctggactgtctcttgttattacagcgagggtataactctttaggatcccgacccaaggtttggtgtgtttaccgtggccctttcctggtgggtcctgagctcaaatttatgtctttttccttgttataaaattgccaaaagctcagcccatcttctcaggcttccaaccactatgtttggaaatgaaatatgccttgaaggaaaaaagctgccaaatgctggccttgcagtttttgcagatcttggcccccaaaattcttagtcatagtgcccttctgatgccttcaaacagatatgggtgtgtatgcacgtgtgttattttgtccatcttttctaattgttctcagtaggaaatggggctaagaaacctaggtaacactggtagaagcagaggtgctggcgacacttaccatagagtagagcataaagtccttatcgtgggcacaggatctggtcattattgatggttaaatggctggacatgccgtgaactcttctatgtcccagtcttcatctttgaaatcactgcatccctaggacaagttttctcaccatcacagtgttgacagtccgggccagatggttctatgttgtcaggggctgccctgttcatggtaagatgttttgtaatgcctggtgtttacccactagatgccagtaggactctaccccacaactgtggccactgaaaatgtctccagacatttgcttctgtcccctggggatcaaaatcacccctggttgagaacttggggtaatttaagtggtgctccggtaaaggccattcaacatgactcactgtgttgatgttatgttttctaacattgactttcctttaaaccatagggttcgaaaccgccaagtcttttgccctccatggtgcacatgtgatcttggcctgcaggaacatggcaagggcgagtgaagcagtgtcacgcattttagaagaatgggtaagtgcttgactgttgttgttttttttaattgtcaaatacacatgccgggctaaccatatggagatttcagtggagtgtgtaaagtttattgctcttggaatcatgtctttatttttaaagtcatcttcactttgtttgtcttatgaatgaaagcatgagcaagtccattattattcacgcatttgtttgtagttcattgtcagtgtcatctgctttattagtcaggggtttgagaatgtttcttcctttaactcatttattaagaaaaataaaacgtggtgaacgcccatgattgcaactaggagactgttatgcttatggttgttaagattagaaagaaggaggctttaaccctatctctaatttcttacttttctctgtctatgtagaagttgatgttgatacgtgtctacataaatatttactaagggcttgccttagtcttgggaccaaggatatagtattaaacgaaacagaatccctgccctcataggcttaccttctaggtaggaaaaatagaccataatcaagtttaatatttgccataatgtcagtaaataaaggactgtaaagcagaggaaggtggggggaatgatagcgtgagtgtgatggagtcatcagcagggagccttccaaagttgtgacatttgatctgagacctgaatgaagtaggggtaagccatgcagatgtcaagagaagtattctcttagcagtgagaagagcatatgctaaggctcagaggtaggcacaagcctggagatttcaaggatcatcagggaagctagtgtggctggagatgaatggagtgggtaggagaggtgctgttgggggatgggtatctggtagactctgagatagcggtgaggaagacattagagggtttgagctagagagtgatgcgagctgtttgatttttgaaacatcgctggatttcagaatgaagtccagactgcattcattcacttttcattcattcacatattcatgaagtgcacctctgtgatgggtgctggggtctactgttaaggacaacagacgttgccactgtctttgtagagctttcagcctattgtggaagacaaatttagtcaaaaaacacagatcttaatgtaaacttgaaaaagcagtgagtggtcctaggaatcagtaatgatgccagggagttgggagacctttggggtccccaaggaagaagtgattgaactaagatctgaagaaagacctgaagagggtggagaagggtcagatggggtaggggaatggcaggtgcagaggccctgggaggagggggaggaggagatagagcagcgtgtttgggagcagagcctgaagggggctgggtacaccctgtggaggccgtcttcatttttgaatgctgtgaaagatttcttgccatttgaagaaatagactacagtgtacttaagaaaatttttggtactctggactgaaaagtagtgaaaataaagaaaaggaagatttatttctgctttttcagtgtatttatgatgaaatatttgaaattcagtatatttgaaatgagcccttatcttgagctcactgagcttattattttgggttaaataaaaaagaaaacagagtcttactttttctgatcattttattgtctttctgactaatgttaaaaagtagtaacctctagtaggtgggatagtagcaatttttagggatgtattgagaagagtacaaatgggaatacgtgcatcttatttgaatctacacgcagaatgggaaggtgaaaaatgaaatgtgaaagtcgttcttggtccttctcttggaagataaacattatgtattcttccagaaaaaggttatctatataccagcaaacacactcacattctgttctgtactttttttttttttaaacttagtactgcaggagatctcttattagtgcatatagatctacttcattgttttaactgctgtataatattccatcatgtgcttatgctataaccagtcttccctttggtggccatttaggttgtttgcattgttttgctatttgttattccaagcaatggtgtttcacagttctctctttcttgcatcagtctttcttacgatatcatctgatattgggcctaaactatgctgctgtgagcattctttatttacgtatttgtgagtaaatgcctggggcagaatcttagcactggactccttgattcaaagggcatatgcatttaaaattttggtaacagttcccgagtcattttcttttttcttttttttctttttcttttttattttttttttgagactgagtttcactctgtcaccaggctggagtgcagtggcacaatctcgactcactgcaactttcacctcctgcgttcaagcaattcttctgcctcagcctcccgagtagccgggactacaggcacgcgtcaccatgcccagctaatttttgtatttttaatacagacggagtttcaccatgttggccgggatagtctcgacctcctgatctcatgatctacacacctaggcctcccaaagtgctgggattacaggcatgagccaccgtgcccgacctcccgagtcatttcttatcttgttgctccaatttccattcccactgacagtgtagacagacaactgctgagggcttgcagtgttcttgggactagcaggagggcgtgtcaaaattgtaaaactctgcctatttgatgtaatatttgaaactagaaaggtaaaattccagggacgctagtgacactatggtaacctgattgtacagtgacattcatgtttaaaccagtcttggaagataatgctgtagcacaactgtttttgcatcattaaatttatcctcttcttttctgagaacacaatatatatgagaacacattcatctgcatttatcctattttaattattgtttgatgcttagagcagaaattcctggacctgccccaattagcgatgagaccttgggtaagcctctggatctatttggagcctgtttcctcatctttaaggaaaaaggttggatggatgatgtcaaagacccactgttcagtctttctttcttatattttgagccttaattgggtccctgtgagtcaatttccgatgatagaatttgctgttttatagttttactctaacatgtagtaccttgagatagaccagtgatcccagactaagaattattcagaatcattcaccgtcggggacacagaaaaaggaaaatggaacagaaacaaaactaatacacgtggctccagatgtttaaaattagatttgataggttgtaggctgaagaaactcaacctgttcatcatctctcatcttttcacttgttctctctgtatgccattatattgtgttcctcattttcccaagatgatgattatggaaactcaaattttgcaccagaagctgtagttaccatttcattccattgcaccattcataccctgcagagaggatgtgaagtcgtaaggccttcttgctctggtgacatctgttaggcttcgtctctatatcatcccccaactccttgacccttgatatttgctggtctacttcccttcaggtccttcctcacctcacatctctgcgcaaggatttcatctggtatgtcactaaatattaccttcctgtgtttctcaaggtcaatttgatagactccaatttttcaagctgctggccagcttgagcgtattcatatgttacctacgatgaatcacatcagtgtcggggccgggaaggtactgcaacatattggcgcctcacgggaggctctcaaaatgatccaaagttttttgttgcagcaaaagctcattcagaagtctttgggccatttggctcagcggaggctgtcatgtgccaaggctccgtgggcattcttagctctgcttctggagataagagttcattcctccatcccaacttgttcttccctgcccattcttcctcttcctgccttcactgcacattccgggatcgccatgttctagaacattcatgtctgccttttagccagcagaatgctattctcacatccacaatgggacagctaacagcccccatttatcaaatccctgtcatatgctgtgtcaggcactttatatccctcatccaggaggatgcaaaaacctggtgtttttcttttttttttttttgcattttccagacgagccaagggatggctcagaagggtgaaggaactcacccgaattgcacagctggtgagctcagagtcaggctccttgcttggtccatctggcttccaaactccaagtctgtctgctccaccccatggcccatctttttaccatgtttagtatcaatgttcatactttgcagattttgctttcaaactctctagctgcggtttgagtgattaatttcaggatccatcctatttcttagaggaagccactctgatctaccctgtcgtctctttatattcaagatatcctttatagagctctcaaattacttttgggaagaaggagctatttaataaaatacaacttaagtgaaaacacattccatatagaagtatattaagaacctatatgtaattactatgactactaattatttcatgggaaaatgccctcctgctgagatgttttagatgctccaaagttagaagagaaaaaatgaaaacaattaaaacaggataacatggacagtacagaagtaaaccactgtcttaaaaggccaatccatttggcataattaaaaaaagagggaggagatggaggcacatcagcccccattcatatttaaataaagaaaacggggcagtggggcttgttcctatgttgtggaacagcacacagatgtgatctacctcattcacatccttatgtgaattatacactggtgccctcacctcttaagacaagcacctatcgttttcctgtgtattccaagaggccagtgtggctggtggaataagatgttttcctgttttcaagatgcagtggactctcttttatttaacagcagtgtctatgtgttaggaatccatgtgagttctctaagtctgggacaacgataggtgtgtctgagtcctgcattaccatggtttattctttcctttacccagtatctattggagttgggcttctgttgctttatttctcggggtctggcatatcccactccctgtcttgagatctcaggacctctgagatctcaggacctctgcatgtaaagaacaagagcttattaggtatcaaaacatacttcatgaacagctacagcaagacctcgacattccagtgtagagctcttgaaagaccccagtggggctctgagttcctccttcttctgtttctattagatttctaaattttagtttctaaattttagatccccggaacttgggatctaaaactctggtcctgtggaagaaggaggtagggtagagtgggagcagatggacctgatgtcatccatctccctacgttgtttgcaggaggaaaagggatgaggctgaggctgggaggcaggggcggtggattgagagagaggagagggattgttatgagtaaccaatgttcctcatgcctgccaggccctcactagatctgtttaacagagagtgcagaagagcttctgttggggactggccattagtatagcgaggggcccaataagtgttgtgaaacatcagcatctgctggacattgagatggccacaggttggtcagagagggctggtatgggaagaggggcaggtggctctcccttagagttactatttgactcacccctgacttcccagaatgtgtcttgagtctattaccctctcatatgggaggggtgacccaagtatgtttgtggcaaccaaaatgtctccaggcattgccagatgtctcttgggggtgcaaatcgtccccagttcataaccacggctataaaacatgctgtattatagtggcaaagattagaatcagatacatcttatgaccttgggcaagtttcttaacttctttaaacctcagtttcttcatctgtaaaatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatgaaagtgcaaagtgatgcttacttttcttaacctctccaactggctgaaagaggagctctagggcagatgtttatcagcctgatttcagtggagttgcaatgaattctttttctgtcttcatatgtctggactcctacattttaatggatgtgtatttagtttgttgattagtattttccagtgtagctcatattagcactcaactgtcatttgaaaagccatcttaactatttatgtgattgctttttcttttgtatttacaaagaaatacactctgcatatattttggaaagatgattaagggattagtcatcaggaacagcaagcaatggtttatatcaaaatgattattgagaaagcagagagatgaggggtaaaaataaaagatttattagccagaggtaatggaatgtgcatgttttagggagagagcgcatgctcagttgattgcaaccacacggtttgctgctgaagtgctgtaatgattcaggttttcaatagagttgatatcgggtctatttattttgtgggagtgaagggatagggatagtactgacagcattatgtgattgcagcctcattgattagcatcggaaataatgactttaacattattttcagatagggagcactcagtaccaaccattatattaggctcatgggctcaacattttgctgtgcttttcatagatactgacacctgtgttttcattttgttgttgttgttgttttccctgccgggaaactgccgcatcctgtgttttcatggcatgatattaaggaacgatgggtaggatgctgaggagtaaattgctcgcacttttaaagacttctgcaaaactccacctacttttaggctccttaaaattcagtgactttatgagctggtatagcttcactgtttgtgggaattccatgcaatctcctttgacactaaaagcttaagtcccatgatttgcctttgtggatggaaggccttggccttcttttatgatatatgtgttggggggaggcatgtggtatgtggggcgggtaaaatacgagcctcatgcctgtctaagctggtgacttggcttggaaaagatgatcattcgtcaacgcatcacaagtcacagggcttatctccattgttctgaacgatctgtagctaaacaaaaagataaaagctattaatattattaatagttgtagattaccgggaagagcgcatcctaaatcagccattagatttgttcctcatttctttgctttacaaattgtttttctgtatagtattggattttcaataaataaaggatgatataaacaagtctgcaaaccagcaagaactatataagccacttgctcaagtcaataagcgcatgctcacaaaggaacgtaaagttctgaagttcttctttggggcgtttgcaaaatgtcctattattgtcacctgcaggtggggggttggatattcctatttgtctttgtactaggtactgtgcttagcatttaacagtaaagtatttatattatgtgtgaaacccattgtgcagatgaggcagtttagaggctggaagaggcatagactttcccaggctcacacagctgggagataacggggtggatccaagatttgcagctggtgtgtgggtgatgccggaagattggcctttttcaaggacttagacaagtattgtactcatacattatttgcatttatttgtatgaatacttctgggttcctaatatgagggtacctaaaaagtacatccgctgcgcttcttgtaatctgagggagttgatgaacatgggccaaggaagctctttccttcgccttccgttccagacttccttttcgagtagtatatcgtgtatttactgttctacttcagttgcctatttgacctttcttgtcacaggctcagggaagattctttatcagataataaattattcatccccctcatagacataatcggttgctaaaatattctgagtttcctgtctccagaatacctaaaacttgtgcttggtacttatcctctaagttttccgtttcatttctcattctgaaaattttgcaccgacttagtcttgaatgttattcattgttctttgatcattgtctttgtgtcttctccttttttttttttttcctggccaccgctcgcagtcttgaaccgaatctttcaaactttatatccatgtaacctttgtataatgagggctgtgattaactgcagagttttaaagagtgaaagtcaagcataggtggctggctctgaaccatcactcccaataatgtgaaacccaaagcagatgcatcctttcattaatgtggggtcccctgagttcttattaagcaattttgacatagtttgaagagacggatttcatgttcagacagtgttcagccgccaatggctgaaaggcctgcttttggccacttggcatttagactccattatttaagaggggaaaaatatgcctgagactgtttttcatatttattgtgggacatttagagaatctcagactagcaggtgttagattaaacagaggagaaacggtccttgtggtgataaaacttccctacgcaaggacaagtagagaaacaactgtagatgaagcagccagtctcaggctggggcagcacgccctgcgataggttaaggtttattttagacaaatatttaaaatgcagctaatttttacatatgcagacgcaacccagtggaatagaggtagccccagctttggagtcatacagatctggggttaaatcccagtgtgaatactaactcactcggtgtccctgggcaaatctggtcatctctctctctcttttctttttttgagatagggtattgctctgtcacccaggctggtgttcagtggcacaatgatggttcactgcaaccttgacctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattacaggcatgggccatcgtgcctggccttagtcatctctttgaaccttggctgatttacctgcagatgctaatatgactctcagattctggcacatagtaaagattcagtaaatggtcgttgcagggaaagctaacttgtccaatgcagatctgtaaaatatactcataaatcttgttggagcaatatttcttctttgtcttacttcgggctaataacaaaaatatcatacaatgagtggcttaaatatttattcttacagttctagaggctggaagtccgagacgagggtgccaaccttgttgagttcttagtgaggtccctctttctggtttttaagtagcctgtttcttgctgtgtcctcatatggtggagagctgagaggaattgagagagagagagagagaggtcgcactgtctcatgtgtcttgtaagggcactaatcccttcatgaggattccactctcatctaatcacctctgaaaggccctgtctccaactaccatcacatgggcaattagggtttcaccataataattttggagggacactgtattagtccattttcatgcttctaataaagacacacccacgactgggaagaaaaagaggtttaactggacttacagttccacatggctggggaggcttcagaatcatggtaggaggcgaaaggcacttcttatatggtgtcagcaagagaaaaatgaggaagaagcaaaagcagaaactgcctgataaacccatcagatctcttgagacttattcactatcatgagaatagcatgggaaagaccggcccccatgattcaattacctccccccgggtccctcccacaacatgtgggaatcctgggagatataattcaagttgagatttcggtggggcgcagccaaaccatatcagacacaaacattcaattcacagcattctaccccagccctccaaaattcatgttcttctgacatgctaaatacatttattacatccaaatatccccaaaatcttaactcattccggcatcagctgtaaagtctatgtctttttaatttttttaaatgatcaaagcactgggaagtagccacttctttcctcagcttcccaccaatgtgtcaattaataatctgactaaggtggccgggtgtggtggctcacacctgtaatcccagcactttgggaggccaaggcgggcggattgcctgagctcaaaagctggcgaccagcctgggcaatacggtgaaaccccgtctctactgaaaatacaaaaattagctgggtgtggcggcatgcgcctttagtcccagctactggggaggctgaggcaggagaattgctttaacctgggaggtggaggttgcagtgagccgagatcaggccactgcactccaatctgggtgacagagcaagactctgtctcaaaaataatagtaataataataataataataataataataataagaatctgactaaggttattaaccattaaggtatgctgtgctaaggagcagggggccccttccatccgtagagggcagaaaggtgcctatcatgtcttcagtgtcagtgccctggtatggagctagctggccttccacaggttctggagttaatgctggagagaagtaggggtgtcagagcctaccctgtgttcctaggggggttcatctggagctagtccctgacccttaggtggaagatgcagctatgcccaaggttctgaagaccctgtaaaaggaagccttagaagtggctgcgattgttttaaagtctgtccacaaattctttgataattctcctttcaagaagtagaggccagttctcctctcttggaatatgggctgtacttagtgactcactctccatgaatagaatttggcagaaatggccgggtatgactcctgaggtaggtcctaaaggcttcgtggcttcttcttgctcactctcttggatcactcaccagccaccatgttgtgaggaaactcaagcagacctgaggtgaggcccatgcaacaaggaattgaggccaccagccatgtatatgatcccccttggaatcctccagcccagtcaagccttcagatgactgaggccctggctgattcatgtcatgagagatcctgagtcagaaccacccagcagctaagccacttctgaatccttgacccacaaaatatggtaagataccaaatggttactgttttaagccactatgctctgggggaatttgtgatgtagcggtagataactatcacaggatccatggcctcaaggggagaaggatccttaagagagactggacagtgagttctaaggataagacatgtatacttacccaggaagctccactgtgtgcaaggaatcctaagttcccggggttgcatccatctcccaggtcaccttgtttgacctctctccaacacttttaaaacatacctgatcaggaatcaccccgctttggcataagttcctctctccccatgctgcccatcccatttctgcacacctcttaattagtaagttctccctcatattgaaggcagaatcttcctctgagcgtcttctatgcaccggccctggtcctgccctccgagttccactggctgcattctcatcagaacccagctaaaactcacgtctctcaaattccctaaataataaatccaaagttattgaagatattgggatactaaaagttggcagtgagactggccccactcatttctttgtaacccctgtccctctttttattattgaagcttgggatgcacttggtaaggctaggcagctggagagcgtgcagactcaggagccaagacctgccttgccttccctggagttaatgaatcagtgtgaatgaagagcacagtcttcttttaaatggcaggggaaccatgcacttatttaccggcaattctcagattctaattgttccgactacaatgcgtcctgtaaaccgggtagctgggagaaacttcaatgcatctttgtaatggctttgttgttgtttattgagagggactaattaactttgattattgcactaatattatggcactttgacagcccttcagatttatgactctgggaaaataaacaaatgaaatgcaggtgctggagcagaaagaataagttattactgaactttaattacttggaatgcgtagccaggagagaattagttgatgaattacaggatgcttaaaatctacatcaaattgcaagcaataagaagataaaaataaaaaggaaggggcaggaagggtgctatttttaaggcagggaaggataggatgcatttgcagtggtctccgtggtgtttcattgattaaactttgtggtctctaatgctgcagatatgtacatggtgctactcaaagcatggtccctgacctgcagcatcagtgtcacttgagagcttgttggaaatgcaaattcttgggccccaccccagacctactaggtaagaatctctggaggtagggcccagccatctgtggtttgcagttactccaggagattttgatatctgcagaagttgagaagcatggctcaacagttctcatgcagcttgctttttcttttataaaagggcgggtacacatttttatctttgcttatgaaaatcaaatgttttcccaacccagtttaccaagtagctcccaaattttcaagctattttaaaaattggctgaaatttaaaaattttgggcaattttaatttatccaacatctattacgtgctaggtggtagagtgggtgacacaagatagtctagaaggattttgctaatgaggtgatacccctaaactgtcatcgatgccagcgcctgggtagtgtggtaagagtgatactcccatgactcatgaaagatggtctccccacgtgctttaaagcaggatggttgcaggagaaagtattggtggactgtgaacagcccccatggcaagggtgcatctggagctggaggaagagcatccacagagtgtaagtagtttgtcctgggaatggagatgtcaggcttgggtgtggtgtcggggagagggcaggcagctcctctatgaggccagatcattcggggccttggattccagtcttaggagaatagactttattctctaggtcctggcagccatcactggctgagtctgagtggtggtgatacagtccatactcagtgactgagatagacagacatttgggctgaattagcgaggggagtgcggggtctggagactctgttggcctgttggccatggtcctgggcgcaaagagcagaaaaggacgagacggggactgaacagacttgcttagttcctgacattcaaggaagaactttaacgtccatccacggagcctcaaaggctaaaaataatcatccctttcaatagttcctgttgtgaggaccattaacaaattataagagaaagcattcctcacttgtagaaactccatgaaaacagacatgtgtttacttatctgcaaccctgtgttaggaggagggtgatgagacactttactgtttgaatcaggaagtgctgacagtgaagggaggagctcttcataattatacccggagagcaggcaagacagccacatgcaagtggcctggcctggctgggtttggtacagaggggattagggcagattcaaacctcactggtcccccgtcccagcacttctgtgctgtctgcagttactaagcacttttcctgtttaagttgttgctgttttcattcccgcaaaagctcagccagcctctagcccaaaattgtctctgtttattggacagttggaaatgtcactgtggccccacagaccttgttgtcaagcaggctgctacgcttttattctagagcgtctttcatctgatttcctccaccatctggaaccttctggattcttcctcttatgggtagtgatgggcactttaggagtaggaatacatgtcagtgctagaccacatcctttcatacccggaattcgcatagtgacatttaaaaatagatagcaggccaggtgcggtggctcacgcctgtaatcccagcactttgggaggccgaggcgggtggatcacttgaggttaggagttcgagaccagcctggcaaacatggtgaaactgtgtctactaaaaatacaaaaattagccagttgtcttggcgcatggctataatcccagctgctcaggaagctgaggcaggagaatcccttgaacctgggaggcagaggttgcagtgagccaaggtggtgccactgcattccagcctgggcgacagagcgagattccgtctcaaaaaaaaaaaaaaagtaatcattttagaattgctttctcttcgggatggtttacctcgtgtttagtctgtaaacgcggataaccgagagctggtcaaatgtttacatggggctgtggaccattttgtatcattggaggagaagccagggcacttggcaggggtgttcatgatgataatcaggtggctgggtggagtcaccatttgtggcatcctcaaagacttgccaacatagacatttttggggagacagaaacacagaaataattctgcagtgctttaaagaatctgttaaaaatcaagtttctttcagtcatgtatgatccattgggctttatataacttttagcctttgctttgcagggacagcaaagatgtgagcaaatttgtgcaaacctaatagggtgaaaaattgaggtatgaattagtaaagtcatttgtccttctggaaagagttatggattaacagattacatttgggtatattgtggttgtgaaaaggtaacattctcagattggaaaggactttctgagatcatccaacttaactttccccacttgacagacaagaaaactgaggcccacagaaggtaacttaggcaattaattaattatagttaataattaattctgcctgcagaacaggaatatggcccccaacgcttcatgcttaattggatggcttattaaattcttatttttatggtagtgatgatgatgataataataataataacagtagtagctagcattgttttccagtgctaagcactttaaatgcattaattcagttcatctttatgacaacactatgagatagctaatattatgaatcctattttcagatgaaagactgagtcttagggaacaaacagccgagagatgaaatgccacagggatgtctaggttcaaacagcaacagaggtgcgtaccatagggatgtggaagccttgcttgtcttgttcctcttggtataaccccagtgagtagcatagcgcctggtcaattggagggatttggtaaatatttactgagtgagtgagagggtaaaacagctgagccatgggagttataacttgggcagcagtaatcctgccattgtaggaggggacagatcggctggttagtttttggaaagcagaccagcagaagttgcaaataacttgttgtgttttcctaagtactgagctgtgtgaattggtttcatgttgatgttactgaagtctccccaattcatcatctaccttgtagcttgttgaagaaagagtccttatttacagtctattatgttaaacgtattttattccagttctttgaaaatgacccatcctgatttggaaaatctctaacttgcctggtcattctggagcagtgggagccgactgtgatgcagagtggactcataatccagcttgattttgagggacagaaacctgggcctttaggtagaatgaacagcttaaaaggctgcacctgagagtagggggcatatgggtaaatccagctgtacccaagagttgggggcatatgttagccctactgggtaaatccagctgcacccaagagtagggggtatatgttagggctagtgcgtaaacccagctgcacccgagatatggggtatacatgagtgctattgggcaaatccagctgcacaggagagtaaggggcatatgttagggctagtgggtaaacccagctgcacctgagagtaggggtatatgttagggcttgtgggtaaatccagttgcacctggcagttggggcatatgttagggctagtgggtaaacccagccgcaccggagagttgtgggtatatgttagggccagtgggtaaatccagctccatctgagatatggggtatacatgaatactagtgggtaaatccagctgtacacgagagtagggggcatatgttagggctagcaggtaaacccagctgcaccccagagcaggtgtatacatgagtgctagtgggtaaatccagcagacgtccggactgtgcttgagggtgtcatcgagagagagaaggttgatccgaagttagtaaaggctttaaaaattaaaaggcctgagatgatggtagggttttggaggtaagtataaaaaccttcttgttttctactacttaaagctgaaaacccagcttgggttggctttgcttctaatatccttcttcctttttgtttcataagtaattgtcctgaagcctgtcgagataaatgtatactgaaagagaaagacacagaggagagacaggcatacagagaaagagagacacgcagacacacgaaggggaggtggagacacggaggagggacagaaagacagagagagacagaaggagagagagagagagaacctgtctagcggtgtttttatgaggtttttagtgctgggctttgcatcgtggtgacggtgtgtgtgtgggggtgttgatcactgttttcagtgttctctgatcatttcttgcttagaaaggaggaaattagaattgttgagctatgatttgttttaatcagaaagaaattgtctaacataaatctcttcgtgagctctggaaaagcccctaaagcggccaggaaaaaaatatcaatactttgcaaaggaggaatgattgttccaattcgtggcttaattgactttaagccttaatgaaactaaggccggagcgggtggcacactccgtggctgggatccacagtgaaatctacgctgggagaggaggaatttagggtggtaatttggttctttgctattgacgaaattttctaattgactggggttacttaataccagataatatttttttcttgctataaagagagtaaatttgtttttttctgaggaacacaggaatttattttaaattacagctttttctattggaagcattcatttatgttggattattgttccctgagtgaaatttcactgatgctgtataattaaatatagatttttttagagatagtatatattttagatgtataagtggataaactggaggtatggaaggtctttatttaaggagaataaatagcccaccccatcaacatgatggcccttggaaaggactcttttagcctccgcgagttccttttccgcaccaggctccacttacgaaggactgcaaaaacttgctaacgtcatcagtctgaaaggattgagctgtaaaatgtgttatgggggcctaagcaacgcatctggaatttagccttcccaagttcaaatccggtttatgccacttgcgaaaaccatgtgaccttcacttgttcttattgcctcagtttcctcatctgtaacttggggatgatgacagtatttggatcacaagattgttgtgaagatgaactgaagtgctaatgtgaaatgttcatgatggtacccgagtacttgcggtggtacctagcgtgtgctttccaagtgctggcaaagaaaagaaaagaaatgcttggggctctgcctacctgtctaggctcctgtctggccattctctttcttgttccaaccatatcaaactcactgctgttgctaaaccttcctgtctctctgcatcttggcacagactatgtcctctgcttggaagggtctcagctaagcttttcctccccacatctgcctctgtatcctgtgagtctctgttcaagggtatctttcccacaaagctttcctgggcttctctttcctgtctcctgccctcccttccttcttttgttcagcacatcgctgtcaaccttcttctctgggtcaggtagagcactgagcaccagtgatatggcagtgataaagaaagcaaaggttctcactgggtgtggtggctcacgcctgtaatcccagcactttgggaggccgaggtgggtggatcacgaggtcaggagatcgagaccatcctggctaacaaagtgaaagcccgtctctactaaaaatacaaaaattagcagggcatggtggcgggtacctgtagtgccagctgcttgggaggctgaggcaggagaatggcatgaacctgggaggcagagcttgcagtgagccgagattgcgccactgcacttcagcctgggtgacagagcgagaatctgtctcaaaaaaaaaaaaaaaaagaaagaaagaaagcaaaggttttttcctcccaagaactcatggtccaagttttggtttttaaatatgcatctatgacagcacggatcacatagtgcattgattgtttgcctgtaggtctccttatttagtcaacaagcatgttttgatcctttattctataccagccgtcccactggactctcagcacatataggtatgcgagacgttgtccttgccctaagtgtggagacagacacgtaaattaatagtaataataatatctaccacccactaggggtctatgtgtgtatgtgttgggggcggtgtggctggggagggaagcaaggcctgtattatggcccaagctcaagaatattcgggcaagagcagatacaatgcctgtatttctcatcacttttgggtggcataggaccagttggttatgagcgtgaaaggttttctttgactttggtggtctagttagtggttgagaacatggattttggaatcagcccggtggaggttggaatcctggctgcgccgttctgtagcagtgttgtggatctcagacaaggtgttcctgcatatgcctctctatcttcctacaagaaatggaggtattgcatccccgaaccgtaggatgcttgtcaggattaaatgagataacagtgcctggttagtggcacatgctcagtaacacctgccaagtaccactcactgagccgaaatctcctgaataccaccccttcatgccttgcacatcctgggttctaactcattgaggtgcccccacctttccttcttcccatcaacaactcttgtgcccacgagggactggcctcctcagtgccacacagagcctcccctgagtagatttgtgtcattttcaaacaaagcatcctggctgcagtgttggattttgtaggatggtgaccgtttacagaaacctctggtccgtgagccaatttggagaaaattgaatcattctctgtgcctttcggcttgcatcctaaaagcctgcacaaacactttgggcaggcttcagcaacttcacatcaagggctcaattgcagctccaatataaaaacctcccccgttgctctctgtgtgtgaagctggattccatgcttggcacagacctcggtgctcacggtaatgcttccttccaccatatcagaaggtcctcagcagccgcagccacttaacatgctcggtgcttctctgtaggaggatttttaaaaagcaggaactgtcagggtcccaaatgttcagtggcacttcagccagaggtaggatagggattttgaagtgtttggagaagtgttttcatatttgaatttacggggatggggtgggctggggtaggcaagggacagactgtagcgattcgcttggtgttttctcatgatgccagagaaaatgacctcattatcatcatgctcacattcacctttgccaggacccctgtgtagaaataatcatgaacttagtgactgacaatcataagcgttttatgatttgtggaggatttatatgtgaaggaaaatggatgaattaaaaatattaaacagcttagccggcacccacatggatgaatcaccgagatctattttttccccgtttatactataaacatatggcatgaattttctgctctcattacagatgctgagagaaggcaaagacaaatatttatattacattcatgttttacagtaaaaacactgttcggtttgtttacacagttccactgttacagtttttatggtcggtaatgcaaccaccgtaaaagcaagtctgggttatatagcagatgtgataagccctcatactcagagagatgtctgggaaagaatcgttgatgtcacatgtacaggatcaacaatggaattatgtgttgggacagtctaagttatgctgtaataacaaccaacctcaaaatctctggggcttgaaacaacaaaggtttatttcttgctcaaactgtattttcatcatgagttgcttggagggatctgtgagatggggatctcactcagccaccggggcccacagagcagcctgcactgctggatgttgtgacagaggaagagagggatgtgctgaccctcgctctggctcaaaagtgactcctgccatctctgctcacattccattggccaaagcaagtctcagggccaaggagtgggcagtagtagggtgctgtgtgtgtgtacaaacccaccatatgtgcatagagggaggccgagaactggactatcagagaatagccaaagatttctttccacggtcatgtcaagcctttttgctgttatttaattgatgttctatttttaatgcaacatggaatcagaagaatatagaacaggcgtcaaagaccctcccgcctctgtaaccgcactgtttaaaattgatgagactctgtcttcattcgaagatgatctgataggaaggattcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtaggcatgaaatgctggagatatgcgttcattcaaagaaaataaaaaggcgcaattatgaaaagctctcaaagtgactttttattttattttttatttttacatggagtctcgctctgttacccaggctagagtacagtggcgtgatctcagctcactgcagtctccatctcccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagagcacccggcctcaaagtgactttaacagcaacttaaaggcggtggctagctctgccccattcagtatggtagccactggccatgtgtggcagttgagtgcttgaaaggtagttagtccagattgaaatgagctgttgatataaaataacatgactcccaggtttcagacagtataaaaaaatcttaattaacatttttatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagaggaaaaaagtacaatttggtatttttgtcacaaatccttaattgctagaactcacagtttaacctgacagttgatcaattgatatcctttgacttgttggaattttattctttacattcgtcttttaaaaagctttattttatgccagatgcagtgcctcatgcctgtaatgtcagcactttgggaggctgaggcaggtggatcacttgtggtcaggagtttgagaccagcctggccaatatggcgaaaccctgtctctactcaaaatacaaaaagttagccgggcgtggtggcacgtgcctgtaatcccagctactgaggaggctgaggcaggagaattgcttgaacttgggaggcagaggttgcagtgagccaagatcgtgccactgcactccagcctgggtgacaaagtgagaccctgtctcaaaagaaaaataaataaaaagctttgttttaaaataagtttagattctcatagaagttgcgaagaatagtctatagtattcttcacaagggttctgggtacccttaacccagcttccccagtgatagtcacagcataacaatcaagtctgggaaattgacactggcatgataatattaactaactacagattttatccgagttctgctagtgtttgcatgtactcatttgtgtgcggctctctctgtgtgtgtgtagttctatgaaaagttataacatatatacatttggtttaccaacatcatagtcaggatacagaactgtcccatctccccaaagaaacaccctttaccttagtttttattctttgagttatatcttaaccaggttaactgagggtaattgtcttaggcaagttagtaccaaatgatgctcttggttccttgtctgtctttttgcccatccaacccacccttcacacatggccgagttatgccaaactttgcaagaggtgccaggtgggcacaaagaaaagaggactgcactcaaggaacttagtctttgaggccaagcacggtggctcatgtctgtaatcctagcactttgggaggctgacacaggcagatcacttgaggtcgggagttctagaccaacatggtgaaaaccagtctctactaaaaatacaaaaaattagctggccgtggtggtgtgcacccgtagtcccacctacttgggaggctaaggcaggagaattgcttgaaccgcggaggcagagattgcaatgagccgagatcgcgccactgcactccagcctggtccacacacagagtgagactctgagacttcgagactctgtccccaaaaaaagacgcaaaggagctcagtctttgaagggttacagaaacagtttcactagaaggtgtgacattgtgtaacagaaatcggttccttaacctgccaaagggaagaaaatagtgcggaatcttttctccaggtttcaggacccatgtctgttgtccttcctttaccttaacttcagcagggcaagaatggttcaagccacattagaaagcagttactttctcacccaattttaaaggagaaaggtagatgcggtgggttctagggatttcagtgacgtaacaggtgtttcccaggcattaagacctagtaaggtttccatttccattaggtattatggatgcattccaagaatttaattactataacatcacttcattcattgtaattccttactagagttatgagaacttgggattgtgtggtttcttattcaatcgattaaaaggtacttgctatagttttctaactagctatttatatgaaatttagtacttgtcaatatgtattaaatcaatacagttatatttatcaaagtggtgagaagagtttacatctgaacatagaatagattgcttgccttggccgggcgcgggagctcacacctgtaatcccagcactttgggaggccgaggcgggcagatcacgaggtcaggagatcgagaccatcctggctaacacggtgaaaccccgtctttactaaaaatacaaaaaattagccaatgtggtggtgggtgcctgtagtcccagctactcgggaggctgaggcaggacaatggcgtgaacccaggaggcggagattgcagtgagctgggattgtgccactgcactccagcctgggtgacagagcgagactctgtctcaaaaaaaaaaaaaaaaaatagtagattgtttgcctcagttgggaaaaaataaagttttaaggctctagaattggagtgactcagctttacttgaaaaatcccagaatagtaggaccatcatttagaagtttcgagacgataatattagggaaaaataacagcaaatgttacttgatagacactaaactctggggcatatgagatgacccaggctggaaaaccactggcttacataaaggtattgacagacccatgggtgttaagatccttcatggctactggggagaaatgacaggccttttgaaatcgtatcagtggttttccctgggatcactggaaataatacccctgtttgacaagatatgacacatgctctgttttaattctgcatttgactaacagaaaagattggtgaagatcagactctgctttaaagttattgaagcagggtacaaggaaaaggggaagggaatagaggctgcagaggagaatgggggaagggggcaggaaggtaaaatttggaggtgcaggcagagtcaaggtcatgcctgaggcccaaccttcctgttgaagctggtgtttgattcaagctgtggctgagaacgtgcagctcatctggagggtagagttgcaagacatgggttcaggtctgagccaagccagaaactggagaaagcgtggcttctcaagactaggaatacctagattccagaggtggcgtgggcatggggcacattgtgacaagttaacagcaagatcttcagagctgcagctcacctgtgccacgatggtctcctaggagccctttcctgctgtagtcccgccccgaggggtttcacttcccactgcctcttggtagccgtgggcactttggtgctctgatgatgtaacatggagattgtccttgtctccatcgctgtctttactggtgtatgcccatgaggtatgtcaaagtctgtatgtctttgtaataatgctggatcatttgtccaccttcagagacaactgaagacagttttaagtgaaaccacacagagggcatataccattgggacaagaggtctgaagtctatttttgagaaagagaagagatcaagtagttaacagccagtggctatcataataatggcacctaaacaaatccttcttttttattttatttaattaattaacttatttatttttgagttggagtcttgctgtgtctcccaggctggagtgcaatggcgtgatcttggctcactgcaacctccgcctcccaagttcaagcgattctcctggctcaacctcctaagtagctgggattacaggcacctgccaccacgctcagctaatttttgtatgtttagtagagacgaggtttcaccatgtttgtcaggttagaccggaactcctgacctcaagtgatccacccacctcggcctcccaaagtgctgggattacaggaatgagccaccacgcccggctcaaatccttcttacttttcctcaagaactcacttcccacccaaacctttcctattgtggcagctgttatcttgtccagcacatgtgtccacacttggtattaatagctccatcttaggaactatgaaagtgaggggggtggtggtaatttgcatgaactggtttgggccagttatggtctgttacatccttgctgaaatggttggtgctaagatgagcacttggcttaggccagaccagtccctagcctgtggagaaggggcaatctcttatctgaaggcctaggaggtgcagggatgtttatatgggctgctagcgcttagtttcctgccacagggagacagtaagaaaggtgacgtcaatctgagatgagagagagagcaaaacagttcttttgaccaccttgaccccgaccttgaaataaggtggaactaataaatcccgctttgtgctggagcaagttttggctgagtttctgtcacttgcaaccaaatcagtcctatccagtatacctagtgactctctggtctccaaaggctatgcctgctgggtactgagtgtctccccgaccgaccccatgatggctacagtgcacatcccttccagccaactctattgtgcacacatattcgtagggtgagttgggccccaggtagagtgattggctcagatcctgcatcctttcagggtctgactgtaatcacactggcatggcagggggaaagtgtattggatttcagagtcaaaaaccacttggtatgaaacccagctcattttctatgtggatgtccaacctgagccagataattaatcttggagatgacgctgcatacttcatcaagttgtaaagttgactgctgtgataatggagaatgctggacaggctgcttttcatgtcatgggttcgctatactttagttcccattatatcatcctgccaatccccatttgttgtttttttgggacccagggtatcagtcatctgatcattgtgtgactttctcaaggacctttacttgagtcttgcacctctggtccacaatgtccacataccagcttgatggtgacttgtgtcattctccatccccttgttaagagaaaatctactttatgagccctctttccaaccgcagtgttgaggactagaccaggcaagatgatgccgctggaccactggatccagctggaccgctagaccacagagcccctggagcctcccaaggccaagcccgccagccacacacacctttgtgagaattaagaaaagatgccccctcctcttggggcccacagctcctccacctgggcacccagcctggtgaacagggtgcaggctgggatttagccctaccttgcttttggaccattgagctactaagttggagcaacaaggcttgggaatttttctttgatcataggtaggaaaggtaaaaaaacataaatctgccaatagaaaatagcatcgtaatgagtttctactatatttgtttgggctttgaaaaatatgccgccacaatatatcaatgtatggtcccaacgttttaggaagttgcatttaaaaaatcttggatacctgttttgtacatattatatatagcatcccgtgtgaatatgttaattcctttttatgagtttcggtcttttttccctctcctatacatgattgctgttttatagctccagtttggtggaattaacatagatttcccacatggggaaggttttgggtgaggatttagaacaaggcaggttcttgatcctcggaagagattcttatctgagaggggatttgagaatggcattgcagagtgggaggcgctgctgtgtggaaaaatgaactggaataattattagaacagttctcagaatttacaggatatttgatcataggagtaactttcctcaggagtgatggatggaatgcctgtacttggaatatttttaaattaatctattttcattacattgaaagtatgacacacagagaacactaaaattggatgaggcactacctggaattatataaagaatgacaaagatgcggttatccatttattttctaggcaagttagttagcctctctgtgtttctatttctttgtttataaaagagggacaaaaataggacctattactatctaggtgacaggatcattcataccccaaacctcagcataatgcaatatactcatgtaacaaatctgcataagtacccccttaatctgaaataaaagttgaaattattaaaaaagaaaacgaaggccgggtacggtggctcatgcctgtaatcccagcactttgggatgctgacgcgggtggatcacatgaggtcaggaattcgagaccagtctggccaacatggcaaaactccgtctctactaaaaattcaaaaattaggcttggtggcacgtgcctgtagtcccaagctactcaggaggctgaggcaggagaatcacttgaacccagtaggcggaggttgcagtgagccgagatcgcaccactgcactccagcctaggtgacagagtgagactccgtctcaaaaaaaaaaaaaaaaaaaagaaagaaaacaaaaacaaataggacccatatccctggattgttgaggaaatacgtgaacatatgtggcacacattatagtgtctggcatacaataaatactttgtaatgttactggtgtcttcttaccgttattgtctcactggtgaccgtttgaaatgttgaagctttattgttacagataatggtggatatagtctcttccttgtttattttttgacagaatctttttttaaaaaagtttttatttgtttggtgagaatttacttgttacaggtctagtgctgttatagttgaatgttttgaattatgtaacttaagtgaaacataaagctatgacttgaattttgtggttagaaattttctcagtcgattgacaaggatggcgtattggccaccttttgccgcagtaacaaacaatcccagactctcaaggcttgcaaaaataaatgtgtgtttgtttgctcataacacatgtggctgagggttggccgtggctccacagtcacgggtgggctttcctgggctcagcttctcacagcgtctccttgcagggcccaggctgtaggagatgtcatcagggcctgcagagggcaaaacctcacagaggcttctgttcatacattgttgtacctcatgtgtgcgtcatattgtcatatatcaatggcagtagccaagaccaacagccaagaccaatgtattctgcccacaggaaagtgaggcaaaggcagggagggaatgataattgtgaacaaagaattcacttgaccaaagatggttttcttgatatggttgccacttacctttcagtaaaatagcacttcacaaatttgtttaatgttttatctcaagctcccagaagtagctaaaaccacgaacatacatgttgaaaatttcaaaagggaaaaaagaaaagaaaggcacatctgagtcaggaaaacattaactagtcttatttctgagaatcaaaccggtggtcttttcagtgatcagtcaccccattaaccacacatgaatggcacaagtaggaaatgcctgcttcaataccaagaagctggtcttatttagatctagtcttatatcattgaaatatcattagaattcttatggaaaatatgttttggctgtttaggggatgctaggggctggaagtgagaaggtttcaacaccatatgggtatgtgagtatagatgcttacaagaagaagggtagacttagccaaaactaatttgggatttttgtttgtttgaattgttggagggtggatgagagtgaagacatatccttttgaaacttaatttaatttttatttattattattattattattttcaattttttatttttattattattattattttctattttttatttttattttttgagacggactctcgcactgtcgcccaggctggagtgcagtggcgtgatctcggctcactgcaagctccgcctcccgggttcctgccattctcttgcctcagcctcccaagtagctgggactacaggcgcccaccaccgagcccggctaatttttttgtatttttggtagagacggggtttcactgaagtagccgggatggtctcgatctcctgacctcgtgatccgtccgcctcggcctcccaaagtgctgggattacaggcgtgagcaacttaatttaattttttaaaacaatatatgtctctttggagtcagggtgtttgttacagtgatgttttgcagacaggtttattggaactgcttggtaggtgataggtttttctttctgttttttaattaaaaaataagattggccgggcgtggtgtctcacacctgtaatctctgcaatttgggaggccgaggcgggtggatcacctgaggtcaggagttcaagaccagcctggccaacatggtggaaccatgtttctactaaaaatacaaaaattagcctggcgtggtggtgggcacctgtattcccagctactcgggatgctgaggtgggagaattgcttgagcctgggaggcagaggttgcagtgagctgagatcatgctactgcactccaggctgggcgacagagtgagactccatctcaaaaaaaaaaaaaaaaaagatttatgtcaagaattcacatttctggcctctcttaaaaatattggaagacatggcaataattatctgggactgaatagcagctgcttctttttgggacaggtgatcacccccaaccccaaacccctacccttaactcttctactcctttggatgttatccctgcctggtttaaccatcaaccctcttaactcccgatccttttaaacttcctctactctttttattcttagcacttagaacccactaacgctctatgtaactgtcttacgtgttccatttcttgtttctagactgtctccctccagtagaatgtgcgttctgctatacagcagtgctgtgtgacgcgatagcaggtcctttttaaacatctgttgaaggagaaaatgaaggcacacgtggccttgctgacatctgagtttgcaacttcttttatgccttctgctaactgggaccccagtgggcttccctgctacaccctctgaggttccccagtcctgccaagctgttccatccccagttccttggtgcctgctggtacttcaccctggagagcccagcccttccacttgttcagatctcagtctctcatctgggagggacagcttgagcactatgacctgtgtgaagcttttcccagtgctggcagactgactggaacctgctccttcattaaacctgacagatgcctccacctggcagttctaccctaagaccatgaacttcttgagggagggagatgtgacttttcatccctgggacccagcagctggctcacctcctactggttagtgggtgatgattggatggcttccgaatgaactcaggtgtcttaagtaccgttggtcctgacaccatggccaccttccagaaatttccacatgttaagattgcagatgcaggctggacacattagtgatttctaagtgctaagaaaaaaaaagagcggctcacacctgtaatctcagcactttgggaggctaaggtgggcgaatcaccccaggtcaggagtttgagaccagcctgagcaacatgacgaaaccctgtctctactaaaaatacaaaaattagccagacatggtgctgggcatctgtaatcccagctagttgggaggctgaggcaggagaattgcttgaactctggagacagaggttggcgtgagctgagatcgcaccactgcactccggcctgggtgacagagcaagactctgcctcaaaaaaaaaaaaaaaaaaagaaaaaaaaaagattgaacatgtggaatatgagacaaatgaaaaagattgaattccgttccaactgggcttttgaatttattttcgcacttcctattttttgagcccgggagtgcaagatgtaagctaagaaaagataagatgaaagtattgctctaacattctggcttccttctattagagaagaatgcaaatctttgccttatctcgatgatgggccccacttaaccctttgttttactgagagcacttttctgcagatgatcaagtggaatttactatgatggcctgtcaaatcttgaaataatctacctttaaggaagaaaagtttaactagatgattgtaccttttagccatatctacaattaatttgaatgtattgcaagctgtttaaaatattccattagtgaagaaggtaagcctagcttctggtaaatacactactaagtgtttatagtacatttcatattttacatgatttcctttataattctgcttatcttttcattctaattccctgaaggacatataaaagaacccctaaagagagtaattactgctgtactctttaaccaaggctccttttgcaaagagaaatctgagctgctttttaaagaaggccgtttttaaataaaaatgcaaataagctactttgtaaccacattaattacccacctagcctcttattaccatgtttgtattgtttgcaaatactatttacagtcgtgtggaaattaacattactggtcctgaggaaagattgtgttggggaggttgtgctttggaaccaattagggcgaaccttgtctccactgagactctggggaaaagcacagccttgcaatgtcaaataatagcattagctctgactgtacaggcagagtgctgtaattatattattggccctattttgcttctgcaatgaatttcattgcctgcattgtaaaatcagcaggtagcaaagtttctgctaatgatttaatgtactctctgatcattttggacaaaagtcatggtaagatccacaaggcaattttatcatccccactgactactgcctggtttaagcattttaagtgaagacaaaacatgattctcatctccttgtttcctggtgaattccttcccacacagaagagagaattacttgtctaatatataatttcaggcataaggagaaggtgatattgcattgcaaataatagcagttagtgggagttgagagccagctctgcaccagactcgtatcagccacttgacctccattattccttattccttggtacctctgcgccatctgtgatatcagatccttttttctgcaaggaaactgaggctcggcgatactaagaaactcagccagggtccgtcagctgtcaagtggcattgctggcacccagattgagggccatctgactccaaagccacctgactctttcccatataccacagtttctaatacgatattataccaagctttaatatgagcacacctcctggatgatgctgtaaattagttgcctcccaccacaccacatcaagtataatggatataatatgatttttcagaattcagctaattacctactgagctttacattttgtaacttttttgactgtccatcaaaatgtctttgggattaaaaatttttttcatatgttttgaggtcaatttgaatctgagtttaataaacgttaccatgaaacatttctcccatctttttaggaaatatctgtgaataaactcattttgtgatagaaggctgtgtgtttatccagttttcatcctaaggagagggggagaagggaaataatacttcacgtctttattgcatgccaaacgtttatagacattatatgatttcatcctttaataaccccatgaaaaggatgtcattgtcttcacttgacaaatgagggagatggcagtgcaatcaagacatactgacaaggagaggaggtgagcgacttgcccgaggccacgctgctgataccttggcagaagcagaatttgaaaacagagcccccatatgttttaactgctcattggaaactgactaggtcacatactcctcctccttccctgtactggtagtttttcttttattttttttttaaatttcttccattttctttcctttttacagcaaatttgtagttatggtggagcaaagggcagttttcactcctcttccctaaaactgtagtttaactaaaaagtggccactgtctcctggtagcggttggtaagccatccagtctctgcaggcatctacgctccaggtctccagtctgaggagtctggctcctggggcaggtgcctctgggggtctctgccaggcttgtctggtcatgcagctacttccagactgattcctagatcttgcatttttacataggacatccccagcattcaaagaagatcctgggaactggattcctaccagaggaattagaatgaaaccaacaaaactaaaaacgacaccctcccccatcccccgcatccgatacacatgcaaggtaatatttgatgtcagtaggaaaaaaatccagtgttataggagacaaaccatagcaagcaatggcctctcacccttcccttcacaccctccactctgtccacttgtttgttccttcaataaatactgatggagaatgggctctatgccagtgtttctctggatgttggctgcagggatgaacaaaggcaacttctaggagaaatttctgtttttgatgctctcgtggctgcttcctgtgtcttaatattgtgcttaaactgccacttcttcagctgttgatttcaggcactatctaatgacttttgctgttacgagcatggatttagctcatttttaccatcttccctagttgtatcaccttcctcccattatgtttgtaacttcagattttgtatatttcgcatatgtcaatatgtaaacattttatatatatatatatgcattcacacacatgcatacatatatgtaatggtatatatacatgtaagtttccatttttgctcaaattgctctggacagttctttgctctgggagttctttactccctttctcataagaagaggctgtttgtaccctgatcaatccctctacctcttcttttcccctttcacccgtaacttctgctacttatacttctgccttatcatggtccataacattcaccttccactctgtagccataattaaatctcccatgcatcccactttgggaggctgaggtggatggatcaccaggtcaggagattgagaccatcctggctaacacggtgaaaccccgtttctactaaaaatacaaaaaattagccgggcatggtggcacgtgcctgtaatccaagctactcgggaggctgaggcaggagaatcacttgaacccaggaggcggaggttgcagtgagcccagatcgcaccactgcactccagcctgggtgacagagcgagactccatctcaaacaaacaaacaaacaaacaaacaaacaaactaagaacaacaacgaaaaaactcccatgtattatctatggattgactgtaaaatatgagaagcaataaatatgttcatcactagggccatctagaaatttctaacccaagggtcaactaatctttccctgtgttgtatttcctgctctgcggatccggcatcatgacctttgtactacccaggaaagccagtgttctcatgggctcttctcttttttatgctctaccagatgctagcactgtggcatgccattcgctcactagcagcttaaagggtacaggttctaaatctccttagtgctactcacctgttatttctgagcctgcgtagatgatcttcttttattcagacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtgatcaatggtatgagggaaaacactaatgtatgcaagaagagccatttcctagtaggaaaaatatttatgtatggagccacaaaggtgatcgcttcagtagaaatcaccaaggacctggtagtcaatgtgcaacctaattttctttcaaaagctgtaggaatggcaagggaggaaataaataatgcatttctttatatctcctgttttaagttactgagtgtcgccaagagatttctaaggccagacattgagtcagctgtaaaactggaaggagcaatgtttgctgactgttgcctcagccgctgaccctgatctcctctgcacgtagtaggcagcttaaaaattcctcgcccgacttctgattttcacgtgactcactgcttagttgtctgggtttgttttaattcctttccccctgctgacagttctttaagtggatgtctataaaggttggggcattcgctcttacaacaataggaaaagaaaggaggaaggaataaaaaagagagaaaaggaataaaaaaaagtttggtttagatgtctgatttctctgagcctcagtttcccagcatgtaaaatgttgtgagggctcacactggtcttgtccaggtgcttagtagagcatccattacaccataaagtatcacaaaaatttttaatatcatcattattactgtgctttcccttgagtttttttttttttaaatcagttaatccacatactggcagatctgacttccttgttttaggccctggggaatttttgttatctgtagagctggattaattttacagtgtggtgcctttgcccaaggtgaacctgtctgtttatagaaagtgtcaccaagttctgtcttgggcccgtccactcggttatatgtgctggaccctgggtggaagcactttgcacgtgtgcattcacgatgggctgtgctggaggggaaaacaggcatcactcccaaattctattcatgcaattaaaaattcctttcatttttatttgtgagagggtatgggtgcacagcagacggcaaacagaagaaaagcttttgattgaaaggtaaacatttacttctgccttttaaatagacatagcaagtctctttactctcatggaagcagttataaggaacatagagctgaagagaatatgaccatttctggtcttttactatgctcgtattaatccaccctggatagaagggactgtactatttggaaacacctaaataaaatgtttttgtcttaaggtgttaaaatgtactcattaatgtggcagtgtattccttttcttctgtgatcgttgaagtagggaaggaatttcaactaagaaccaaaatgattgtctgttaagacacttattttttgagaagacaaattaatataacattattatgtggggaatgtggaaaggctaaggttgtattgaaaacttattaagcttatgagaatattgaaagcatgaggaggcatgaccggaaggtattaatgatttgggcttgattattctaagactgtattctaagtctaaaatgttgataactaagacctgaaatgataaatgtttggcaaaaccaaataaatgagtagcaggttgaaaaaagaggcaagagagaagtagatatttatagttttctaaaacaatttagtcccttctggaagagagtcctacctcagccatgcctaccaggttgtgtttgtgggattatttctgagtcacccttaagctcatctttacccctctcccagacccccagtcccctcactgggcattccttggattatttatttatttatttatttatttatttatttatttattgtttgagacagtctcactttgtcaccaagtctggagtgcagtggtgtgaccttgactcactgcaacctctgcctcccaggttcaagtgattctcttgcctcagccccctgagtagctgggactacaggcacgtgccaccatgcctggctaattttttgtatttttagtagagacgggattttgctatgttgcccaggctggtcacgaactcctaaactcaggcagtccacccgcctcggcctcccaaagtgtaatcctggattataggtgtgatccaccacacccagccttccttttgtttttgatttttcctctttaaactctacttgtaaccacccctttcctttcccaaacttttactagcttcttccatcctggacttgcaatctggctgaaaacctgctaaataagggaacaattttgacatggctcctgtactccccacaaacctagttgattccagaccagtaatgtcttggggacagtgttgtcccatcttcctttctaggctgggctcagattactgacgtggaagagttgttggtcctggtgcaacatgccatgaccatgaggcctctggtagaaaggaaggaatgaagggtggttctccaaacccttggcccatgcctcatccttctgttcccttccttttccaggtacgtagctggtcaggtttcttaaattccgtcgatctggctttatccattttaagccttaggttgttggaacatagctaagttggtcaccttttcaagaattgaatctcaaaaaagccatgtagacctcggttgtaaccatcacattcattgacttggttgttgatctgtttgtcagatcagttttctgtttggggaacatttttgtaagtgcatgtatttcagcttttaacattttaaaaataaaatttcattgggaaagaaatttcattcgactggagtaccaggaacttagaatgaatccatttgtcagcagtatttataccctgtctaaaagagtgtcctcccagttctctgtctctgtactgtgtccccactttaaaaaatagctcaacctctcattatatttgcaattttttgtttttttcattgcctggtgggtttttttttttttgtctttttaaatgctccatgtagaaaagaattcctggaatagttcttggaacagcataggtgaataaatgagcaattattttgtcctcagcactataactgatttgagaaggtcaaaacagaaaataaaaacatgtttcagtagtaccagttcctgcacaggctgtctgccaactatggaagtaaagggaatagaattaggctgtctggattatagtgggaaaacaaaacacaatcacatcctgcctcagcctatccttgaactggtgtctttagaaaggggaggtcaagtaaaggccataaggctggatggtggggaagaaagaggcctgggaacaggtgagaaactgcagagcctggcggagttcatttaacctcactgtggttctgttggacttagtgcaaaatcaagagacccacctttgcctgcccatcctgcaatggtttggggggccccaagtagatgactggggaagatgactgggaaactgcagcactggttcatgttctgggacaaatcaatattaagcaagtttaatgatgggtaggttcattcaaaagggaaatatgtttcaatggagaagagaaatttgttaggttgtataataaatattttgagtgtatttggatagaagtttatgacggaaaaggcaaaattctctgtgtctttatggggagatattcgatatgttttttcttggcagaaataaaacatattcaataatataattaggcaaacttgttttagttgacaagaagaccgtatctccgtctgcaagatgaaggcaagatcaagagatgtcagttaacattcttgcgaccacaggtagggaggagaactggggaggaatttatggataggtgagagcataaaactagatgcggaagggatgggggagcaggtaaaataatgaggctcaatgttcaagaaggtcttgggcaagcgcgtgctagttattttcctcactggtgtggtcgtgacagatgaatcacattttactctcctccctttctcatagtatgattacataaaggagaccttccctggaaagagccctgtgcatggcttttgagagtgggcctgggctaacagtgagtgtggaagcttgctgccttgaattctttccaattctggagagttgatgggtaacaagtgtgtatctatagtctgcttggacatggcggtgtggccactgacacgttgtcagccatcccctcaactccagggacaggaatggtgagaaggtggtgagggcacagtctgcccggagacgggacagtttgtactacctgtagcaagagcatgtctttgagagccatagcagctggcttcctatttggagagaacaagaatgtgaaaagctatttattaccagatgtgggcagaccctccagcctttttttgttcttttaaaccctaatctctttttaaaattttttttatttttaatgtttatgggtacatagtaggtgcttatatttgtggggtacatccgatgttttgatacaggcatgcaatgtgaaataatcacatatgaagaatggggtatccaacccctcaaacatttatcctttgtgttacaagcaatccagtcactcttttagttatataaaaatgtacagtttaagttattattgactatagtcaccctgttgtgttgtcaaatagtaggtcttatttattccttgtatttttttgtacccattgaccatccccacctcctcatcaaccccccactacccttcccagcttctggtaaccatttttgtgctctccatttctgtgagttcagttgttttgatttttagatccaagaaacacaatcttagatgcatagtaggtgcattctgttgccatctgcatcatgggactgcacaatcggagaggcaggaaggccctgagaaatacctgattacacacctgcgtgctgggatgagaaatatgaggggaggagagaaaagatgagcctcatattgcatagcaagtctgtgatggaagcaaagttagaccctgttgatttttatgtcttacctccttgccattagttaggtaaatttagaccaccatattttctaagatcagagaatagagaattttaaattctagattcttgccttgtggatgttgaaaagaacaattaaaagttatttgggatatccaatcagttaataaataattatgaatgaataaactgttttgttgaagacactcttatggcagacatgaacatggggcttaaatcagttctgacatctagaagctcaaatccaggaggcagaggagttggatattaaagaactctgtggtgagctggacaggatgacatgacaattatggaagttcagagcacatagcagtcttttccagtgatggggatggaatgtgggggtcatggaagactttgtggaagagttgcaagtagaattattactgttgaaaagagatggggagttaggtagacaaacagaaaaaatgccaccaaacaataagttaggatagaaaaactccacgtatccatatgtcagttggcccatctgttcgttcatacatcctttcattcttctatccatccaaccgtccttgcatccatctatccatccacacaaccacttattcttcattcatctgcccatctgcccacctacccatccacccttccatacattcatctagtcatccccatccatccactcatctatccacccatccatccacccatgaatctatccatccatctgccaatccacccacccttccactcacccacccatccatacacacttccatctgcctttccaattatccacccttccatccatccatctacccactcatctaccctttcatacatccatacacatccatctgttcattcatctatccatccatgcatccttccttcgttgttttcttccttctatccatctattcatctacccaccccacccacctatccttcacccatctggccatccatccttctacccacaccttccttcctaccttccttccttccttccgtccttccttccttccttccttccgtcctcccttcctcccatcctcccttccttcctcctgtcttcctttcctttccttccttctctttctttcttttgttccttcctttctttcctccctccctttctttcctccctcccttcctcccttcctgtctccattattaacttgctggtattttgtttcaccattgcattgtgtttatcaatagacgattaatggaagaagagaagaaatcaggtgaagtctttgtaggatctagaatgtctaggctaaggagtttgaaattttttatactatgttctattgggaaccatttcagggttttgagatatagtatgatataataacagctatgctaaattctttgaagttattggtggtggaatatcaatccagaatgaaaataaataattttggaaatgagcctgtcattgaaatatactttatttctcgttaaatgtcccagcaaaagtattttggttgttaaaataaaggaacaaccattagaaaggaggaggagaagaattagaaggaaaaaaaaggtaaaggtaaagtaccttggtattttagggtttctaagattaggaactttaaatgttgaccccattttggtctttaccttcaaaagacgggagaaagactgagagaagtttctaagctgatgctgctctactacctggagtaggaatgagaaaccatctataaatattacctttggtgtttccatcaaaaatttagaatttcaccctattctatttttaattctggtttaagactgaaggggttcttggtgaatacttttgtagatacaattaatagttatgaaaatcattactgattacctccagggttcagatattgggctgaatgtcttctctcaccatcagaactaccttttgactagagtgttaattattaacatattttagattagtcagacaactgcaatatttaaggaatacgtccaaggtcacacaactaaaagaagtgacaaagtacggtttcagacccttttagtcttttctgtgttgcaaaattgagataatgataatagctaatgatacctctcccttactgataattgaatgttttatgtgaattaaaaagtttaatctgcatagtgtttcatcaagatagattccttgttatcctcattttggagatgaagagactcaggcatgcaaaggtgaagtaattttcccagggccagagggctaaggaaagggagaattgggattaattctacattgtctactggtaatacctattgctcatttttaccagttaaaactatttaatgagcatttgcccactttctaaaaatatgatggtcttagttacccacatggacctactctatcccaggcagatgccacaaattattttgttttctttttgtatatatttatgctgtttcctcatttttaaatagtgggctttgatgactattcttctacataaattattacatatctgtatcatagaatcttaaaaattatttgattcaagtgtatacataattttcatatccctgatagatattgccaaatatttaccagaagtgaatcaagtagtttttctaccaacattatctaagagggcttgtctttttacatctttgtcagcactaagtattatctcccttacttttttttttttttggtaatctttgttactttgttaggattaaagtagcttctcattttaattttcactcctttaattgagaagcagaacgtattcttttttggtgacttgtttcagagtctctttagtttgaagatacaatagatgtagcatctgctatatccggtaacaggataacagtgcattgctgggatgatgaggctgcagtgggctgtgattgtgccactgcattttcagcctgggtgacagaggaagaccctattacaaaaaaaaaaaaaaaaaagggtctgttatcaaccatgcttttttattttattttattttattttcctgtttctgagttagagtctcttttgctcaggctggagtacagtggcgtgatcttggttcactgcagcatcaacctcctgggctcaagcaatcctcctagctcagcctcctgagtacctgggattgcaggtatttgccaccacgcccagctaatttttgtatttttagtagagacagggtttcgccatgttggccaggctggtctcggactcctgacctcaggtcatccgcccgccttggcttcccaaaatgctggtattacaggcatgagcctctccatctggcctcagcagtgctcttctggctagcttgatcatatgccaatgttttattccttcgtggagctcagagtaagcttgttttactggacgttttctataataaagctaggggatggcgaatcattctaattaccaaaaagctgtctttgataacaatgtaggagataacgaaggcagaaataacatttgagtaattctttgccattctgtctctgaatcttgaaataaatactcttgaatttatatgttcttggtcctttaggagtcataaaaacataccgttacatatgtatatgaaacggtgagaaactgcgtatttattaagagtcacgacccttaggactagacaaatcaaattaaatctcataaaaacctgttatggaatatgaatacgtggcactattttttcttttagggtgtctttattaattttgtcatgtttaatatgttgcagttgcaaacaaaggcataaatgcatgcgttcattcctaattaatttatgtaattgggttttataaatttagctgtttaggaagctgtgcataacacactccatttactgtgtgctgtagccaataaaagcataatagaaagaaatatagtttgaagctcacttcaatggtaaatatagattagttgtaaatgatatctttgtaatgtttattttaaattttgcagtgctgcagattttctgaacataccaattaatgttcttatttgaaataatgactagttaattactataaattctaagtgctccatctctgacaattaaaaattgtcttacagctttttatttatttatttattttttttagatctttccaaattatattaagtgcagcatctggggaaagaagaatgggaatggaaggagtgtgtttaaaatgtgggtggttttgtcaattcctattgggaatgcttgtatttgaatgtatatacatatgcatatttatgtgtaatgtctatttcatgctaaatagggagtgatcaagttgaaaaataagaaatgctgtttgaatttttaaaataggttataaattataacatgaaaatcaaatacaatgggtaaaaccagtaaattttaaataagtttacatttgttgtcgtgatgtgactgtgacgttacctgagatctcagcaaggagctctgcagcccgaaaagaccaactggaatgatttgatcagaaagggaatgggtattaggctgctccactgatactttatccacttcgggagagagagccctgttccttcttcatctagctcaagccaactgtcagaaatgcatgtcagagctacacaattctatccaaggcattaactgttgtcaagtctgttttttatgaatatgtttcaatataagaaattgtcttaggcccaaagtgaaacgtcttcctccttgactcatagcaagctcatgcaggtatttgaacattgttctgtataatatgtgcacctttgagaaatcccatgattcttgctattctttgtaaatctaataccttccatccagagagagagtatacatgtggagtcaattgggagtaccttttgtatcctctagtctgagccttacaggttaaaggagaatgttggatttgcttttgaaagtatgggcttgcggagattaaaaaaaaaaaaaaagaaaccttgaataatcatgtacaaatataaatactgtatgtagaataagtgtaatggatcacatttatgatgaaatatgtatgtctttccaagggtaagaccttcataattcatttataagttaccttctttctcttacatgtaagtagcagaatagtaattttcttcgttctttctgaagaattgccacacagggaatgaaaagaagaaaggataaacttttcttaaacagcagaatgttattcagagataactggaaaaaagtacgagaaaagccaaaaagaaaaaaaaaaattgtgggtcctggtgatgttggaaaaatgacgtgtgagctgaagttccagacgccgagcttcatctattttgtcatgttatgacagaaatcattacaagggtgataggtttatttataaagacttgcttcaatattcaaagtacatctattctagcattcctcattttgagccaggctgtggatcaagatgaaagaaaaattaaattgtatattgaagagctcttaattgagccatgctgtatttaacagggaagcatcggcttcaggcagtcgataccactgaggatttttaatgccctgcatcatgagactgtcagtttgctttggagaatgcaaacaggctaatgacaaagccctgcaaacttttgtagttgctgctggtctctttggaaggcaagtgctaatttacccacagttgaaacctgacacacacacgcgcgtgcacacacacagacacacactctctctctctttctctgtctctctctctttctctgtctctcataaggaactaaatcctgcgttttctcaccagagggctaatgacacactgcttagtcacccaaaacctgtttcctaaggagccactttggggcttgtttaaagtttttaatgtaaggcattatataatattagatttcccctgtttttccttaatcaatgtaaattcaattgcatttcagagggtggccaagtggcatttcatcatctctaatatccatttaaaaatgttaggtctacccagttataattctccaaagtagcctatctgtggtttaatatgttatctacattctctaaggcagtgttaatttccttttgtagttaatctatcctactaccaaatttagtatatttatagttaaagattctgttaagagctaagtgatttaagtacatctgggataaagtggccttggctttaactatgaaacaaattttctttatttcattctcttcactgataaatccatagtaactggaggcatttttagaattgtgggcaatttcagcctctaaagtttgattaaagatacttcagatattcctactgagaggctagagggctgaaaggaatttattttgggttctggccctagtgcagctcagtggaagagaacagacattgtgagtttaattcccacgctgccaatttcccacgagtctagggtgggtgttacttctcaagaaggcgatggtagaaccgctggagacttcttatggctgtggcaggggactcacacgtcacaaggagtccagaggcatggctttgaagagctcttttcattcattcttccttttgttcacttgtacatcaaatacatgctgtgggcctactgtgtgctgagcactgatcttgtcaggttcttggggaagacttcattgctgaggtgacctttgagctgagtgtatgagtgcaagagagagcgatcacacctgggaactgcttaataaagtccccggcatcttgaagccacttgcagaccttggcagttgctgttgctcctgctgctgctgctgctgctgcattgtcaagactacattgatgtcttggaaatatagaaaaaagaggctgctggactgtgtgcttagaatcagtgtgctaactctgttaccaacaccgtagagaagtggttccagaaggaagagttcagggtgagaatgaataacggagtggctttgcagtgggaacctggctttgcagcacagctaggattggagaagatcttcccagcagggagaagaactcaaagaacatgcatgaagggaggaaggttgcaccagtgggagggaccagaatatggtgtggaaagaacgaggttcaaatccaggctctgtcattaactgcccctaccctctctgagctgagtttgttttggacactggagataatgcatgttaacatcctggtagctctatttatttgctaccatggtacataatcatgggagctctatttatttgaacatcttcttttgttattatttggtgtatttgggaaaggcatgtgggagcagcaagcaggtgagcatcctgtttggaatgcagggccgggaactgccctgcccagtccagcctcattccagaggctagcacctggcctcagctgtagagctgctgggagcatttcagctctctgcttctttggcagtctagtgctgtcacagaaggaaagctcactccatggaaaaggggggattgatttcttctctgagggcagaggctgatcaatctaggctggtaggaatagatgtaacctcagaggaaacaatttgcattggcgaaagcaagtcaatggccatccccaaattcaaaaggacagggaagtgtaatcctactgtgatccctaaagcatccaggccccaggaatggtggtgatttgccagggggaaatggaggaacaaccccttctttgactacctctgtagtttatattggattctgcaaagtcccatgaggactgatagatgggctgtgtctgcatttgaattttgtagctgaaatgtgggtgagttcacctaggtccccttcatgacaaggtggtgagaaacattttcttgttctacaaatctgaattaggtccacgaaagagggtatgcagcatagagaggaaccaaaaaggacgcaagatttaggatagatattgccccttgggaggcctgcctggtctgcccttgataactcatgaacagtctggtaatgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggctgtgctttaaagtcattcatggatctggctgggcccgatgcctcacacctgtaatcccagcaacttgggaggtgggcggatcactttaggtcagaagttcgagaccagcctggccaatatggtgaaactccatgtctactaataacacagattagtcaggtatggtgacgtgcacctgtaatcccagctactcgggagactgaggcacaaggattgcttgaaccgtggaggcagaggctgcagagagctgagatcatgccactgtactctagcctgggtgacagagcgagactgtatctcaaaaaaaaaaaaaaaaaaaaaatctttcagggatccaggctgacctcagcaccatctcttacatgtgcctctgttctttccctaatataagggagcatgggggattagtgtctggcttaagcacttccactcagaaatcttgcttctccccacaatccattggtgaaagcaaggcaatggtcatgccccaattcgaaagataagtgcagtcctactgtgtgccctaaagaattgaagatcaggatacttatgagcagcgctcacaactgccatagtggcaatgcgaatggcatctatttttaatgtgactgagaaaataattggtcagatattgcaggatttttgtgggggagagggtggaaaagaacttacagattaaaaaaagaactggcatagcacctagattttaaacagaaggaaaagatgacattggggaccagagacagaaatttcacttctgtgccatgacaaataccagggagatgtaattgcaaaatgaagctgcaaatgtcttacccagggaactaggtgacaacctgcttggcttcatgaagaaggaataatatccaattaggctaagtgtattcggtgcctgagtgacaagccctggagacctgagggcttctggggcccccagggcggtttcaggaggctgtctccagacctgtccggggtgtgagcatgtcacgctgtggcccgcgcctcccctgtacagctgcctctgctcttctaagcactgaaatgagaggtgtaacctgtgttccagagtctgcgcctcccagccactggggcaggggcacctggcccatcagacttaccttgcctcccctgctgcccatgccctgctgcctagggctgggctcatgactgggtccacatcagctccacattgcagactgaccccctggaccctcacgtctcaggatccctatctccctgtcagtgctttgtcacccaaagtcaccgcagctcctcttgagtgctttcaagatcagaccgaggggtcctagttcaagctaattcctacctgtgcgatcactagccaagtactgaacctctctgaacttcaattatctcatctgtaaaaggtgttggtttgtaattgttcctacctcttagggcttttgtgagagtttagatgataaaccaccaagcaacagtggctggcattctgtgcacaatcgaagtctgctgctgtcagctctgtggtcgctgtctgcactcccacccctgtcatcctccaagtctgatctcctcccgaagtctcttcctggacctcagccctcagggattgcacctccctctgaatatgctgtcccttctaatcatgccatttagccacactgcctagcactttcttttttgaatattcgtgtcccaggtccctgaaaaagttgctaagcctgctaaaagcaaggcaaggcctttctttctttgtaaccttaatgcccagcaacgctccattcagtttgaccctcagttggcttcatactttgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatattcaagcagctttacagagactaccatgagaatgggttaaattaagaggattgtctttgctgtttagccaatatgggccaaagttcagtggtttgagacatggcggggtttggtagtagatgtaggatattgctggggaaagagtgttagaggatggaagattgcatgatatttctggctttgctctttgactgtgtgctgtttgtaaaatcacttaagtcccatgggtcattttcttccccatatcaagcacctgctatgtatcaggtgttgtgctcacgtggtgttttatgcacagtgtttcctctttgttaatcctcatgatgattggtatggtttggctgtgtccccacccaaatctcattttgaactgtaatctccataatccctacgtgccaggtagggacctggtaggaggtgattggcccgtggtggcagtttccctcatgctgttctcgtgatagcacgtgagttctcgtgagatctgatagttttataaatggaagtttcccctggccttcattctctttcctgctgctttgcgaagaaggtgcttgcttctgctttgccttctgccatgattgtaagtttcctgaggcctccctagccatgcggaactgtgagtcaataaacctctttcctttatacattacccagtctcgggtagtatcttcatagcagtgcaaaaacggactaatacaggttgggcacggtggctcatgcctgtaatcccagcactttaggaggccgaggcagatggatcacttgaggtcaagagtttgagaccatcctggccaacatggtgaaaccctgcctctactaaaaatacaaaacagccgggtatggtggtgtgtgcctgtaatcccagctatttgggaccctgaggcaggagaatcgcttgaacctggaaggtggaggtttcagtgagccgagatcatgccactgcactctagcctgggtgattccatctcaaaaaaaaaaaaagagaaagaaaacagattaatacaatgatctgtgagatattgggactgttcttattcccatttcacagatgagccactaactggctcctggcaggacagtgaataaggggcacaacagagacacaaacacatcgctaaccaatggtctcatccgtcagccacactgcctgtctcagcatgggccctgtgtggaccattccatctcaatttgtttctgattcttgtcaattaaataagaacagctgaaaagtaaaataataaatatatacataaaaacaatggggggagtaataatgataatagatacaattttttggtctttataatccccagagcctggcttaattattttaaagtaaatcaacactttgaacacttgcaggttagaaaaccagtggactgatggatgcgttacagccattgtttccaagtgtattagtttctgctggccgctgtaacacattatcaccagtgtagcacctaaacaacacaaatgtattgtctttcagttctgtaagatagaagtcctacagggttctccttgggctaaaatgtagttgttggcatttctttctggaggctctgggggaaggtcgttccttggccttttcccatgacgctagaggctgacacattcctctgctatggcctcttcatttttcaaagccagcaagattgcatctctctgtctttcttttgtggtcacattttaccaggactcttctcctgcttttttttttctacctttagggatctttgtgatttcatttggcccacctagataaccagggtcctctccctatttatttttattttatttgtgagacagagctttgctttgttgcccagactggagtgcagtggcttgatcttggctcactgcaacttccgcctccagggttcaagcgattctcctgcctcagcctcctgagtacctgggaccacaggcacatgccaccatgccagctaatttttagtagagatggggtttcaccatgttggcgaggctggtctcaaactcctgacctcaagtgatctgcctgccttggcctcctaaactgccgggattacaggtgtgagccaccacacccagcccctctccctattttaatgcgaggtaattaacaaccttaatttcaccggtaacctgaattctcctttgccacgcagtctaccatattcacgggtttcagggattaggacctggacatctttggttgggaaatgggcatcattttgtctaccacaacgtgagagcccattgccctgcatccacagtcataaaagtctgttcccttcctccctgattcttcctaacttctcctgcctgccttgcaggatatgtggagttatcagttcctagcaccactggccaaagcgaggatagctgattgcactcctactttcctgctggtggaaacagcatgtatataggtacaactctggtgtggggaaaatgctaaagatataaagtagaaatagcctttgtgtgatgtgagcagcagaacaaaaatcgagggtgccaaataatcgtatgaagtggtgaactgcctaagatggaatattgctgttcctaaatcctggctgtgttgagacatgtgatcctgccgatgagatgagagctgaaccactctcttctcccagatgctgggcttccgaccttaatagagaccgagaaacttaacagagggctcagaagagaaatctattgaaagttactaggtgccaggtgtctcggaaagtgtttaacacatgcctgagacgttaaaggcaagattcatgcattctttcagcagacagtttcttcacttaccggggaagggggtgtaatatatgggggtatagggataaataattctgtgtgctgtgcaggccgtggagactcatcttctgcacaggtcaagttctgaagtcagcatataagctggaagtggagtgaagtcaaatgaccctcaaagatccttccagacttcatgcccttggcaactcagtttggacactcatatgctggtttcttccttgtatttatgcagcagcctccttttccacaaaaagcagaggccaacgtatctcaccccctcaatttttttactttccctctccctccctgtgcttgcctttcttttcttttcttttttctttttaagacaggctctcactcttgtcacccaggctagaatgcagtggtgcaatcacagctcactgcagcctgtaactcccagactgaagcgatcctcctgcctcagcctcccgagtagcttgtactgcagatgtgtgtcaccatacctggctgatttatacttatatttatgtatgtgcatgtgtgtttatatatatatatttgtagaaatgggattttgccatgtttcccaggctgggctcaaactcctgggtttaagcagtcctcctccagcctcccaaagtgctgggattacaagcctgagccaccatgcctggcctttgcttgcctttcttaatgtctttgacaattcatgtaaatgtgtgtatgatgtaactctataggactaagggtgtgtgaggatgccaggaggctgttggttgacaggagtcatgatttgactatatgaggtcacagaaaatgctttttaaaatttaccgccaacccacaggaaaactattctccttcttctaaggaaaaaaaaaatgtcacgataaagcagctacattaatgacaggcacatcaaggttttaacgtgttctctagatttatgatgtgtagcgtggtctccattctagaaagcaaagtagggaaagcacgactttggggccagggccctttctggttcagaatgtccctggccagtgtgcgccgtgcagtgtggaagcacgcttcggtgcgcatgtaagtttacgtgctatctgtagggacagtgatttttattcattagagtttttgagtctaattgtttttaaactgccacttttgtttgttaaagatacagatgtctggccatagaggaaagcaaggtggatttatcgttgcaattagatgcttcacaatttgaaaacttatcacttaaattggtgaaatgtcacttttatgcaacttgatgtttagaagtccttggcgtccaggactaaagtcatgtgcaatttaacaagatcttggtgagataaaggaagttgcgcttgaggaaacattgaaacacaccagatggaattttccaattccctcctacatgatagagactaggtgaagggagatagaccacaaattgattttgtgtaactcttaaattaagtggagcagagttaaaaaaaaaaaatcactggatttgaagttggcctatgttagattactccaaggaagttagttaatatgttaatatgaatctagatgaacattgagtgttttgctcttcttgttaatttgcgccatctactaatctctggacaatggagaaaaagtcgtaggttatgagttttttatttatggacattaagcaatatctttaaaatgtaaaatgaagccgacaaaatgcacagccagataacaacaacaaatctaatctaaagtgacaggaagagactctcccagacatttttctctttaatgtaacatgactttaaattgatgcaaccccacagtgattgaaaaactctcagagcttgtctcctatgattacatttctgatctgtacaacttaattttttaactcggtgagtctcagttttgcgaatgaacagttctcttttgctttctctctcatattatttgggaagacattatttggcaaccaggcagataaagctctgttaccacgacgaatactgagaagtcctaaaacaataaagaccccaagaactcaccctggaatatgtacctccaaatctcttctcttttccttctctccttctctttgtttttctttctcttcctgttctcttgttttatcttgacttctctcgactgtggtgacggtttgcatatatctgcgattgtactgaaacttaccaaacattgtacgttttaaatgggcaaaatgtatttgaactatatatatcacaataaagctataatactcttttaaagtgtctcctgaatcattaccagtataattattctgtgaactgtattttgatgaattcagaattaatttaaaatggattatccccctgtagaatgggaggtaatgctgaatgattgtgaatgattgtgaatgtttgtttattcggggtactccctcaaatttcttatccagtggtgtctagaacatgttgggattttgtgtgatagtttcttgagttggaaattgcgtttctttggcctcccatgtgggtatcaatgagttttacatggtttaaaggccagttatgtgatggatacttctattaccttatgtctttctgatttcatacacttaaatgtacagtttttatcttccttcaaaaccttatttttccgagcaagttttatttattcactttcagtcattactgaagtgaataacaaacatataacaatgctattttgggtcatagctgttttgctaagtaatacttaaaggctttctgactatatttttaatttctcgacagtctcccatggttattttctgatcataacttgaaaatcaaagctttctgttcagtttaaccatcttttaaaacccagtggttttagcttgggtattaacctttaacatagctagcgaaaattgaacatttttatttgaaatatgcttaatgttgtcttgtgtaagacaaaaagtttagggacaagtgaaccatttacttttcttttaatgtggaaagcagtttacaaatgctggtatgactaacaagaatgaaaggaccagaatggcagttctgagctagaatgtgatgagtaagtaccaccatagttagcggctagggaagggaggttgttctacagagaaacatgcccatcatttcttctgttacctggtattcactctggcaatttctttttggactcattctaaaatcaggattaaggatatccactgagaagcttgcatttattactctaagcaagaaacttctatttaattttttaaccatttgattcatatgtatttagattttaaaatttcattttctcttatccaaatgtatcatatatctttaagtaggtgaatcttggagtagattttattatatatcacatcacagagttaagctcggttcatctggattttaaaaatctctacagctttgagaatgactttgaaacactctttactgttggagcttaaagaaaataaatctctaatgtcctctgtattaattcacctgcttggaaagttagagattaaaaggtttagtaggatttttatattttctataatttctatttgtattggagtaaactgttcgttgtatggagtggcttagctttcataaaacagaaagattcctatattgagaaaagaggaagaaggaaaaagtgtaatataaatacataaaacttcctctagctttcttgtgttatgtgtaaaggagttagtacgttactttaattgtgtactttgaagaaagcaatctcctatttccattaatggtggactctgtgggtagagacatggatatttttccttttataagaaaggtcttgtctttcctcagaaggcattgtgagcaaaataagggaagaaaaagagaagtagataagaaaaacaaatcacaatattgaagcaggacccgagtactatagccttcctcatattttggtatctggaaccgaggttgctaattaatgacccaagagctaagccttgtttgatgaaatgcaagatgtaatacacagattgccttggagtgatgtgtgattattaccatccattcatgtgtaatcccgtatttggaaggtttgtaatttgtttttgacacatttctctctgattttatacactcatgcatacaggtctcacctccctccaaaaccttatttccaaagcagactttgtttgtttggtttgggtaattcattgggccctatttgtcttccttatacataatctattttcttactgctgcctctgtcttccaaaccaagaatataaagaatgaagcctggggactggaacttaaaacttctgccgagaaaagaaagtcaaggcctgtgggctcctaaaacatcctgtggaattcgcctcagatgcccctccatttgcactggtatatggaggatgtttgaaaaccaccagaacctattgtgtactttggaacaatggcattttcctgcttgattgtgaagatggccgctggaaaagaagccaactcccagggggcacgaggggctaagctgtctcctgggaagtttgagggaggccaagtgttttccagttcatttccaacgcgtatttcttcagggccaagggcccagctgtgcctcattaggggtgagagtttggctgtgacacgacttaatagaaaaaaaaaaaaaaaaggagaagtccaactagctgagtggcaacagaacttgggacaacctgtgcccacagcctttcatgtcctgtaatgagtgtgccatttgctcactgggaggagaaaaaaatgacagtatgcaacagtcaactttttcctgaagaaagagagaaaaaaatacatattttgcagccgagacatcggggtacctgttaactttaggcacagcgctagtgtcagccctggaaagagactccctgtgaacagcactttttaccatttaatcagcctgtacttcttcgtatttatagccctggcgaggctggcccattgttacaagaggaaattgtgatgttcagcagtttataccttgggagctggaagcgtttctccatggtgaatttgtaatattaattggccatgtcagttcatgacaaatgtagtgacatctatttcaagtatttcagttttatggtgctgaagaagtgacacgcgctccagataagtaatctcacaaaagatcttcccgctcgctgtggagcgcctccagaacatgctctcagaggagatgcaaataggctcagggttcagggggctgtccccttccttttgctcaaggctcagaggggagccagaggaatgcagggagggacgcactccctgtcattcccctttcagtctcaggagattctggttgaagctctggcatggactttcctgcccaagaagtgtccttgcggtgatcatttatgtgatttgggtacctgctgcttgtaggctgtgactgtcagtagcagaaataaatatattgcctttctcactgtgtacagtggtgctgtaccaagggtgactctgcccatcaagggacacttgtctggagatatttgggttgtcatatcttggaggagaataggctgctattagcatctagtgggtaagagcaagggatgctgtagaacttcctacaatgcacaggcgcatcctacaacagagaattgtctggccccaaaagtcaatagtgctgaggctgagaaaccctgcacttgtgtggaccatgcccttttatgcttttcaaccttgaagcactaataggtcagagaagaatgccagggatgtgttgatgggtctgcaagaggttgatgggggatgcttgagctcctaccaagtggaaggtggtgtaggcaaagagaaggatgcataggcacattggacggtggaaggcaggggctgctgaatgatgtggcaggaaacatgcaaagtgctcagcgtccctgggcggtgcagagtcttgggaagcaagaggatggagccatcctttcagtttccagcctgggtttcccaaaggagagggtgtttgagttcagtggcagagagagtggggaagagtgttggagcccagctgagtggccacctttgtcaaatggagctgagaaatgattttcacatggctggcgtaatggcggagtttccaaaacagcagcacaacaaaatagccatttacatgtcaagactatattcatagaatccatatgtctaaggtggggaagttgtcattattcctgttttatagatgaggaaacagaggcccagatggagtaagtgactgctgaagtacacatgatttgtcagtagaaaggaagagaccaaaggtggcatcaactttatctttccttcttttttttgagactggagtcttgctctgttgcccaggcaggaatgcagtggggtgatctcagctcattgcaagctccgtctcctgggttcacaccattttcctgcctcagcctcccaagtagctgggactacaggcacccgccaccaagcccagctaattttttgtaattttagtagagatggggtttcaccacgttagccaggatggtctctatctcctgacctcgtgatccgcctgcctcggcctcccaaagtgctgggattacaggtgtgagccaccacgtccggcctgtttttccttctttgttaagtggaacaagtcatttttttggtggtcatttccaatatgtaattcctgataacacacgtatatattatctctttaaaaattaaaaaaaaaaaagccagccaaaaaaagaaaatggaagtgttcaagaaactgccttttttcatgtaatagtatttctgtgtcactaaatccttcaacagcattatttttaatagctgcccaatgtcctaatggatgggtgagtcatgatttacttaaccaatcccctgttgttggacatacaggttattcacagcttttctctattgtaagtggaattgcaatgaatgtttttgtagtacacaccagtgagtgattccttggtgcgcttggaagtgctggttccaagaataagataaggctttgagattaattgccaaattgctttcttgaaatattgaggctactattttccagtatcttcactaggaataagtaacgtttttctaaagctgagtagtaagagaaaggtagaatctaattttactgtgcattttcttgattattagtgaagctaaacattattttttattgatgtgttaacaatttctttcttttgcaaatgatctattaatgttctgtgactgatttctatcttggtgtctttacgtttgtgaatggtaagaatttttatgtgttcaggaactatttaaatgttcaagacattaacctgtggttatgtatatcacaggtacagtcacatcgcttaacaagggagatacattctgaaaaatgtattgtcggaattctgtcattgcatgaagatcatagagtgtatttacacgagcctagatggatagcctactacacatccaggctatatggtatagcctcttcctccagggctatgaacctgtatagtatattactgtaatgaatagtgtaagcagttgtaatacaatgggacatatttgtgcatctaaacacacctaaacatagaaaaggtacagtgaaaatatggtattataatctgatgggatcggcattgtgtacatagttcgttattgactgaaatgttggtatgaggtgtatgactatgttttctcatgacctctgctttttttgtctttaagtttttaatttttgttttacttttgtcttttaattttaattctattgcaaccaaatctatcagcctgtcttctatgatctctgcttttaattgttacgctttaaaaatccttctccatggtaacattatattgactcatatgtcttactggttgaacgtgcctatgtttgactttgaaatcattaaattcattgaggatttgttttgccatgaggaattgggtaaggatccagctgattttctccagatgagtagttcattgtcccaacaccagttattgcaataagttattccttccccaggaaatatacctgggctaattaagaaaactgtgcttcaatgtaattattccaccttaatgcatgaaatattaggttaacatggaaaaaacatggcatcccatgttttagtattttttccttatttccaagcagcacctctctttgaattatattctgttctctgtttttataatttgactcccttctattctacatctaaatagtgcattgtctgttttcactcaggactttaaaaatagttctagtactaattgtatttttattctaatactgctattccttttactggtacttctgcatcttaaaaaaacaaaacaaaacaacgaaaacttggcatgttggctcacttggtgaatgaaagcatatactgttcagttgtttattcttcagcaacatctgagtatcctcgagaaatgagtggaatgaaccgctagagatgaatagccttaagccctcaaagctgagccctttggggtaacttgctctaattctgccctctccagtttgagtttaggttaaattcagcttgcagattgcaccaagcctgatgcctcccagccatcaaggaaaagggtacctaacattttgaatctccattaatcttacagctcagatcctgtgtattaaatctcagcattttcagggatgtatactctggcagaaaaactttaatgattttttttttctgatgctgcctagaaaatattagaaagaagacccttctttcctttcctttcttgtcctgtcctgtcctgtcctgtcctgtcttccctccctccctccctccctcccttccttccttccttctctccttctcctcctcctcctctccttttcttttcttttcctttccttcttcttcctttcttcctttatttctttcttcctgtattattttcttgtatagctcaggtctcactgctttgctgccattcttgtggagaataataggtaacagaggtgtgcacctggcctcatttattgtcacactggataggtaatagacgccggcatggctatgctgtggttcctgctgatgggcacactattacaggtgcatgataagtgtgtcgtacgcaggaagtacgtttcccccagccttccctacctgctgagggctgctcccagcctaaggatttcatccagatagattcatagcgcttccagtaaatgcaccccttgcctttcaaagttgaaaaagaaattactttggacacaaagaggtgtttcttttgacacagcaggcatgtgaaaaaataagcaaaaaaacaagagggatttctgttaccattggcatgtgcttctcttttacttctttagttcacaatgccagtggttcagcttcccgttctgatcctcactgctctaatctcttcatctgtgcttgcaatcacagccacgcgggctcgcaatattaccacgaaatcattttatctgttggaatctctttcctgttcattactcttttttatccccaggtagacaaacaccctaagtttacctcttgcgaattgtacgctttaaggttaaggaattcgtagttgaataagaatgacttttcacataaatttaatggagttttatcttctgagccaaggctttatttaaggagtcttgggaggtaatcatgtgttacctgagactctccgcccataggatgtagttcctttccattggaacacatggggaccgagggaataaagaatgttttcatctctgaaaatatctctcattcttccaatcaatgctgctcttttcttgcatactgtatactgggaagcatttgtttcgatttgtggttaaatgtatgtgtccactggacttcagtatccaccctttgaaggaccgcaggagaagttgttcaggtagaaacatacaagggccggatgcggtggctcacacctgtaatcccagcactttgggaggcctaggcgggtggatcacttgaggcctggagtttgagaccagcctggctaacatggtgaaaccctgtctctactaaaaatacaaaaattagccaggtgcggtggcgcaaacctgtaatcccagctacttgggaggctgaggcaggagaatcgcttgaactcgggaggcggaggttgcagtgagtcgagtcgtgtcagtgcactccagcctgggtgacagagcgaaactctgtctcaaaaaacaaacaaaaagaaacataccgggagatctggttctattgaaccccagtgcagccatgggtagaattttaggcttatttatattccatttcaccacaagatgtcaccagggcaccacaccaacatggtctatggaccctctctctggcaaatagagttatggtcatcaaacagcacctgcccagggctatggggagaggaagctggttggctttgtcacaaatgccttgatgtctctttcctcccctggggcccatctcttccagcctttgcatagagagagaaggcaggcaacaggacacaagaagattttcccagagtccagggtgttctcttacccctgaaatcgtttcttcactggatgggaaggcaggcacccagggggagatggcatcagctgcataaacaatttttctcctcagtagacatttacatgagtcaataggaatcatattctctctttttttttttttttttttttggagatggtctcactctgttacccaggctggaatgcagtggtgtgatctcagctcactgcagccttgacctcctgggttcaagagatcctcccacctcagcctcctgagcagctgggaccacaggtgcttgccaccatgcccaactaacttttgtattttttgtagagacagggtttcaccacattgcccaggcaggtctcaaactcccgggctcaagcgatcctcccaccttggcctcccaaagtgctgggattacaggtgtgagccactgtatctggcctaggaatcatattctcttcactgaaacatttcagatgacttaaaaattcaccttgtagaacttttaaaattgaaactttctggtgaacatcattagttgacagatatgtcattgaagtttcatccttcttcatttcagagtctgctggaagacccttcatttaccactctctccttcctggaggtgtggaaatactctacctgggtgaggctctcgtggctttttgtgccaagtgtccgtaaacttcaacttaattgttttaaatcctttgtggtgattatgcggaaggtcaaatctaacaggaagctccatgtccacttgatgtgtacttacttctatttttgcaccttgtgttgtttgttatcctgaattatgccagggctggtttgtgctaagatacttgttatttgacctcataataccagcatgtcccgtttgtataaccctctctgtagcttcttccagcatgtgatcatacatctacctaacctctcccattggttgaatttaatatactagtgaattttccattgcaaagatgaggttacgaatcatagtgttcatactcagaaggactttataaatattttgcctttttgaagtatatacaagaaatgaaaaaaaaaacaggaataaataaaaagaataaaaagagccaggactagaacctacaattcctgactcttgatcaaattgcttttctttttaactctagttaaatattttccattctttttaactcaagaagcctttgtttttgttgtcatcgttttatgattaacttatatctggtcctttagacatttagattttttctgttttatctctctctatatgtatatctgtatatatatttatctatatctatatagagatatatatatatatataaaataatgaatgaaatggactgtttgcaacctcagatgtatttctaggacttagagtgattagcttgaggcgatggtagtttctgtttttggagtctctgtaggtctcagactcacagtctgtacttcttgttttgggggctaattaagtggacagtttcagtgttggtagctcatttaagccataaacatgcagaccatgtggaatcccattagtcaaaccttagcagagtgccttgatgagtacctccttttctttctgaattctattagttgatgctttgttctttctccccaagagccatatctcagctatttcttttcatttcttgtgtatagttcaacatctttctttctttttttttctaaacaggatctcactctgtcacccaggctggagtgcagtggcatgaccatggctcactgcagcctcgacctctggggctcaagcgatccttctgcaacagcctccctagtagctgggactacaggtgcatgccaccacacccagctaatttttatattttttgtggagatggggttttaccatgttgcctaggctggtctcgatctcctgggctctagcaatcctcccacctcggcctcccaaagtgttgggattacaggcgtgagctaccgtgcccgtgcccggccttacgtttcagcatctttcaatccatctaatacgcagtgccagggaaggtttgtgaaaacatttgaatcacagagtcacaaacagtgagaatagctgcagttatgtttgtgatgctctaatgaacttacaaaaggccaggcctagtatttcagctgtgtccatgatgtctctgatggaaatggacaggtaacatgatgtacacaagcatttgactgttgcatcctttgattgggccatgttcatgcagccagcctgggaaagcaattagtagttttaagcatgggaaatcatataaaagtaaactaaaattgcatttgaattaattgatgaacatgtttgcttgaccatatcctgctgttaggcgtcttcaagttaacttaagtggttgataaaactttccaaaaagaatactatcaactgctgagcacctgttgtcagagttgtgggtaattcgcaaaggttttcaaatggaaaagttgttttctcctgctaggaagcatggtctcagatccacttctaaggtcagtgtgaaagggaaggcaaattcactttgagcaggggaggcatgatctggaagataaagcagctaggagtatagactagggggctgatggaggggaacacctatcacaatatgtgttctcacaccaatggtatatattttccacacatttagattctccatgccactccttatctctttagtgcagaaaacggagaggaggttcagtattcttaagaaactcccatgattgctttgaggcaatggatttaacaggtatctttatcccttatttacgcactgactgtggtactgagtcatccctggtgtttctggattttattggcaatgccaagagagcaggaagactgggacgtgaactgacaacatttatgattctggcagcttgacatcacccaactgttctctttgtttggttttgcttcagacttagtttagttttgttttttaagggctggggtggaggagagggatttgctcttgcagttttcctttcaaaccaaactctttcaaagccttttgcaaactcttttatggattttactcactggttgagcaagagttacttatgagatgtggcttcggcattttcacagtgtccataaaaaaatgtatattactatgcattgcacatttgccacttagaatttctgaatgcaaattaatcaacttgcagctgtgactaacaataaaacacaggataatgtacctacagaaatgagggcattggaaatccgctctcaggtggccatcgaaaatagtcagcctgagtgttgctacctgttttccataattgtgtagctttgcctttccttagttaatctgttcaataaactcctctgcagaatccaaatgcttaaattcagtttctttttgtctttatggtgtttttcattgttaacgtggcatcggagtagctcgacttttgcatcatgataaattcataacccaagagaaggcagaaaacataattattatcaattgcctctctcctggaattgccattggctgagtggaacaaaatacgaacttaaggagtagctgattcagagaaatccagggtaggaacgggtcccatcttgatttcaatgtcttttttgaggaggccttcccattgcacttctcttcaagtttgcccagatagtaagttctactagacatgtcaattttttctgaggtctaatcttgattttttttttcctgcacaatatggaattcagtgtttttatttaatcattcagtaagtcttgactgcctgctatggaggttaagccctttactaagttccaaggatgtacctgtgaataaggcaagttcctttttatcattgtctttgcagtctattaggggctacacaatttaaacagagaatatatataaaatggtagaaagtacaagtaagtataccttattttttttaaaaaaatgaatgtggtatttcacccacagcctcaagaatcactttccttaaaattgccagagtaggaaaacttacaattgaagaatttcaggtatttatgggaaaaatagtattagggcaattgcggtcaaacacattcgtctgttcgttcaattacagcagtaaggatggaagtctaaagagagtttctacgtgatcttatttatcctgcatttataaatacacaaattcttgtacaattaactcagtttttcactcctttcttgcttgcaacttgtcaggtcgttccctccccagtagttgtgaacttctttatgctagcttcttccatcaggggctcacaaccagggactgtagaggtttgcagaggtaaatcttggtagataaggattttatgaaaagggagctcactgttggtgaaaaatccttgtttctacagattttgggtcaagataagaaaaattaacttttaaaatctgaggaatttggagattatctccaggggctgaatatatttttatgggagaaataaaatggatagttttaaacttgaatttagtttttcctaatggaggcccttttgaagatcaaatgggatctgtaaaaactctttgaaaaatgtagactgcttcttatgtgattcttactggtctattatttatcaagaaattaaaaaggaatgaatatctgtagctgtttttctttttctttcttttcttttctttttttttaagatggagtctcgctctgtcaccgggctggagtgcagtggtgctatttcggctaactgcaatctctgcctcctgggttcaagcaattctcctgcctcagcctcccaagttgctgggactacaggcgtgcgccaccatgcccagctaatttgtaattgtttgtttctaaaaggatattcagtgcttccactgtcttttagaagtctgtagaaggaaggccaagaaagaaatacccattattttggctgaagatgatcactttagctgaaaccagttcaggttcaaactcagacattggtgctattttcatatatctgaaatgttctgaaaagattactgacgatcaacatgctgaactgacatttcacagatatgcagatttattcatctctgttcaaggtatgccttttccaatcataatagccacgtagaggacattaaacaaatattttattgtggtaaaaacacttaacatgagacctacccttttaacaaatttttaaatatataatttattattattgttgactataggtaaaacaggacatttttaacgtgctgtggtggcctattggactttcagcctccctgggtgtatttcgctgtatatgtgtaccatgtcagcttaccctagaatttgaaacattttcctttgatgattaaattttttttttttttttttttgagatggagtcttgctcttttgcccaggctggagtgcactatcgcgatctcggctcattgcaagctccgcctcccgggttcatgccattcttctgcctcagcctcccgagtagctgggactacaggcgcctgccactacacctggctaatttttttgtagttttagtagggatggggtttcaccgtgttagccaggatggtctagatctcctgacctggtgatccgcctgtcttggcctcccaaagtgctaggattacaggcgtgagccaccgtgcctggcctgatgattcagtttttaccccaagatgcagtatgcctcagtctcactaaaatatgccaatatgttcttcttcttgaggatcagggctgatttcttctactgggaaaatgtatcccctgtgtttggccccagaggcatcagggtaacctgctctcttccattctcaaagcagaaacagtgttcctaacattctaagcctgggaataggatggcaggtcgtgggaccagcattttaattacctaaagggaacttattgattttagtccagaacacggtggggaggagttcatattcttttttttttttgagtctggattttagaataaattcactgtgtacatagctattccatctttaaaaacctttgtgaatgttaatatacagcctttataaatttgaggtataatgttcaaaatgctctaatccctaaattttccagtctaggttattatacttttatgactattcattttgatgtaggccttttaaaatcaattcctccctgttattacaatgctgctttatggtatttgtgatatatcatatgaatatacttgagggtcatgagaagttcatatgtgtgtgtgtagtgtgggccccagactttcgccataccgctggctaaagtggccatgtttttgtacgtctctgcagagcttacaagttattcaacagccagatttctattctgatatgcccttttagttttcaaagcatcgaaaaagggtaatctttagaaccgaagtatttggaaaactcctagacttgaataaggtatttttgaatttgaagagctaagaacccatcaaatcaaaatgctaataattcttccaagtcaaaaggtaactctcattttattatgcattgaccaccattcactttctgttggactgcttttggaaaaagaaccacaagtctctatttttaaaatagaggtacaatgataaaacaaaacaaaacaaaacaaaaaaacaacaaaaaaaaacccacacaggtctcatcagccaagggatttaaaaatcaaatttaacttcaaaaaactgaagttgatatagcaggatcttggagatgcagtttcttcacttttcttttttttctaactgagggattaaggatataaacccaacttcaaatttctttctgggtggtcttgaaaacttaacagtaggtcctgtaaagaggtgggggagaggaaaaagaaatcctttactctcatctgctggttttaaaatgagaaaaatacacacacacacgtaatgatgttcgtgatgttaatggagggaaatatcataaataattaagaatttaaaattattataaaatatttagtattattgttgttactgttattagtaggaaggggccttgccatgcttcctttcttcaaacagctcagtactttaaaatcgagtgtggctgtgtttgtcagtcgtggtttgtgttctttgatttgttctgcatgttcttcttttggagaggatgtgtcactttgccaatcttggtccttgctgttgtctggtggagggaaacaagcctgccaggccggctcatctgacccctggtggcagggagtggaggtgcactcaggatgctcttggggaatcataaaggaggttaaagaaagggacagcagaaccctgacaatccttgcccctaagcatggaaaagcctccggaccgggtctggagtgcaacagaggcccctgaccttgtctctagctctctgtctgcatcttcagcgtggcttcactggtttctaagtctctggtgtcttttgtcttttgcagccggcttgcaattgcctccttctaactctcaaaaggatgcatgggatgggttcagtgtagtcactgttgtgccttttggacaaggctttccagccaggccaccctgtttacaaggctgtcctcacgtcatgggcgctcatattgtccagactagatggtcaaggtgattgggggaaggaagtcacagagccaccaattactaaggaactgcccagagatcctgcctcactgggaacctgtgagtgggctggtttcccccagcagaggggctgtagcatagcaggtacccacaggagcctgggcatggcctttttctctaaagggctggatagtcaatatttttagctttgtgggctttatggtctctgttgcaacttctcaactctcctgttacagcaggaaagcagccacagataatatataaatggacggatgtgttccaataaaactttatttataggaacaggcagtgggccagattcagcccgtgggccataggttgccagcctctgactctggtgttcagatcacagactttggatgtctcatatctgaatctttctaatctcgtgatagggcaaggtaattaaaatgttaatacgttagttttctcactgtcaatgtgttctatgacatcatttatgcaaagcatacaaagctgagaataaagtctcagcaaatgctagtttcctggcctccttatacatacttacaaaggatggtgggagatagtttgagatttgaggcctctgaagaataggtgtttttgtgatgattttggcttttcagtttgacagttggctttgcttttttgacagacacattaagagcttcaagggtcatttcatggtttgtcctttccatgtcagggacacctttcacgtggccattttaagcacaggaattgccttcaagtagtttactcgtacgaacttgtctgtaatcatctttccccatttggatggtgggttgcccattttaattcaaggtttgtctaatgtgttagtgcatattcttggctcaagcaggataagacactagtaaccatgaacctgtatatcaaaaagcgtgactagagtttcatagttaaacatgtgctgaaatccacagtggacaccagagagggtcatggaatctgggaatggatgacttgtcccatgatgataatatctgtgttcctacggctgggcccggtggctcacacctgtaatcccagcactttgggaggccgagatgggaggatcacgaggtcaggagttgaagaccaccttgatcaatatggtgaaaccctatctctactaaaaatacaaaagttagccggtgtggtggtgcatgcctgtaatcccagctactcaggaggctgaggcaggagaatcacttgaacccaggaggcggaggttgcagtgagccgagatcacgccattgcactccagcctgggtgacagagtgagactccgtctcaaaaaaaaaaaaaaaaaaaaaaatctgtgttcttgcctggcttattgagctccatggtaaatgttcagaggctgcaggaatgattcaaagtctgactgatttatgtgcattgggcattttgttgatgtcattcagattaatgatggcactgaaaatgtgtaatggaaatgagaagtttgtatcctgcctgctataccatgattccaatttaagagggggtaaaaatattgcactttttaatctattgttttttgaaagagactgtttaaaacacgtaattttgctaagttatggctcatatcgtatttgttattttggttttgaaaaattgagtaggaagcaattgcgttcttaaatgacttgaacatcaaaggcaagtagtgtcttgttttaggagcagccaggctcctatccctctgatccagccaagtgctttcacttggtcccactctggggaatcaccagtggttctcactctgggagaggcccctggttgacctggaatgacctagaccagcagtcacaagctcctgcccatggacaaaatacagccggtacctctttggctatggcctgcaggctcagaatagttcttacattttcaatcatctgcaaaaaagaataaagaggagaatattatttcttgaaggaggaaaatgatatggaattctgatttcagtgtcataaagttttgaatttcatcaataaaaaatttgcagaaatttgtttttctctcctgttatgtaaatacctctgtaatagcctcggttttgcctcttggctcacaaagcctaagttgtttactatttagccctttacaaaaaaagtttgccagcatctgatgtccaacaacaattttcagtcttttttgtagctcccaaattctctcattaaaccagatcccttgagggaagcctggtttacaaaatagattaagtgatgtggctgtttggagcaggaggctgtggtctgagtcttgctggcctcaaccctcaactcacttccacaccttacctcctggggataaggctgccttcgtctagaaagtgcctcggttccagcttggaaatatccatgtacagtcccttttttgttattccaaaacccaaagagatctgaaaagcaaaaacaaatttattgtatatttatagcaaatttatttggtggtgaaatttgacttcagctttagcgtccctgtttctcctttctagtgtgaatgttcattttgttttgtttgtttttttgaggcaaggtctcacttcatcacccaggctggagtgcagtagtgtgttcacagctcagagaagcctcgacctcccgggctcaggcgatcttcctgctgtagcctcccaagtagctgggactccaggcatgtgccaccatacccagccaatttttgtgtctttgtagagatgcggtttctctaccatgttggccaggctgaataatcatattttcactgaagaaatagaaatgtcattgttataggatgttgccccaaaccccgcaaaggtattttgtaatatgcagtatatgtgctaaattactttttttgttgttgttgagatggagtttcgctcttgttgcccaggctggagtgcagtggtgtgatcttggctcgccatgatctctacctcccaggttcaagcgattctcctgccgcagcctcccgagtagctgggattacagacatgtgccaccacacccggctaattttgtatttttagtagagatggggcttctccattttggtcaggctggtctcgaactccggacctcaggtgatctgcccaccttggcctcccaaagtgctgggattacagtacctggcccaaaatacctttctaacatggaggaattaggaatactgaaggcatcggcccccaagggtttgatgtgctcttgtccccaaggcctgcagatttgcatcacctctccacttcgtggactcctcgtacctgcctgattccaggatgctctaacctggccacgcatcccccgtggattctcagctgttgtgtgtttcctcctcaggtggccactgtgtctggtgctcacccacattttggttcatcctgactttgcctcagcctccccattctgcatttctcccacggcttctcccagccctggcccagtgacactgtaatgtggactgtggcatcccctgagtctaagctgttgaccagctcttgatggacagatgctggcagagatggggaaggtgctgttcccttcctcctgggaagggcaaagaaagcagggtggtcctcccatccccgtgaggaaggaagagcctcattcatgctgagaccctgatggagaactgggtccagggataatgttttgtgttcctgctcatgggactggtgtgttattgtcaagggatcttacaggccttgcttcccaggcccctctatcccctctgttcttgcttaggcattagtgatttggttcttctagctttttttctttttttgagacagggtctcgctttgtcatacaggctggagtgcagcagcgcgatcttggctcactgcaacctccgcctcctgggttcaagcaattctcctgtctcagtctcctgagtaggtgggtctacagtcacatgccaccacgtctggctagtttttgtattttttagtagagatagggtttcacttgttggccaggctggtctcgaactcctgacctcaggtgatccgccagtctcaacctcccaaaatgccgggattatagatgtgagccaccacaccaggctggctcttctagtttttgaagctcacttttcttttttcctcaagactcacagggaatgggaccaggcacctgtctttatacattctcaaagtccatggtgacgatgccatgctccggttctaagccagttggacagacacaggcaagggaagctgtcagtgtgggtgtgagttgcagtgtaagggtagtgggtggaatagcgtctccccaaaatccacacccacacagaatcacagatgtaacgttatatggaaacagggtctttgcagatgtaattagctaagaatctcaaggttaaatcattcaggctttagagtgggccctaaatccaatgacggttatcctcatgagaagaggaaagcagggggcacagtggtgggtgtgcctgcaatcccagctactcgggaggctgcggagggggcatcacttgagcccaggagttcattgccagcctgggcaatatagcaagaccccatctcttaaaaaaaaaataacaccaaaagacaaaacagaaaaaggaggagaggacacagaggagaaggctctgtgaagtcagaggcagagattggagtgatgcgtctacaagccaagagatgccacggtcatgggcagcccccagaaacgaggagagaaacctggcacggtttccacaaggagtcacccctgccaacaccttggtttcagacttctggtctcctgaactgtgagagtcagtttctgttgagcttgtgctgatacgctagggcagccctagcacactgccacatctggtttcccggaggaacttcacagggtctttgttctttatctacagtctctggaagtctcagcagcctcctgtgttcgcaactgtcattccagagcagccgtctcgtgttatgcatttgcttactcataagcaaatatttcacaagaacctgcgagggccaggctgggccaggcaggtattgcaggtgcaaggatctatataagacagtgccctttagaagatccctgtctcattgagaagcgttgagtaaatgggtctctctggtcattctctccagaacatgaagccaaagggctgagagggagagactccaagaatgaattagtgtccagcaaggtatcgcttgtctcaggatgacaacttgcaatttggggatctctcaacgtcctgacctccatctcagtgggcatgttcctcacctggctggctgcccctgcttactgatgcagcctcctgtcacacggtactcacctctattcactgtattccaccaacactggccttgggagccagcagtacccccattgtacagatgaaagtcttgtgactgtcaacattaaaatgagaatgatattgacccatgatacttacccacctgttcagtggattcggtgtgccgtcagcatggttcccagcacatagtaagtgctccgtaaatgtcagcatctattattatcatttgtgtttttttttccccttctctgccttcctttctctccctccttggtctgcttcctcctgttgctatcagagcctgcctgcctcatccttgttccagccttgatggtgatgatgattgtggttgctgttgctatttgtttttttggtttgtttgtttgttttgagagggagttttactcttgtcacccaggctggagtgcagtggcgccatctcggctcactgcagactcttcctcttgaagctggggaagttcaagcaattctcctgccttaggctcctgagtggctgggactacaggcatgtgctaccatgcctggctaattctttgtagttttagtagagatggggtttcagcatgttgtccaggctggtcttgaactcctcagctcaaatgatctgcccacctcggcttcccaaagtgttgggattacaggcgtgaaccaccacgcccctcacgcgcagccactgttgctattgatgattattatgacatcattgctcagattcacttggctcagagagggcggagtcagagtgacccaggtggtcactgctccccttcttgtccatcaaatcagctgcctccaacagcattgcctggcagcgtcacgtagtagccctctccctcacaaggcttttgaggcagacaaatgccactgataaagcaaaagcaaatgttttgggtgaattccccatagctacactagatttgaggctgagaaatggaatgcctgtcattgttgactgaaaaatacagctctcctaatagagtcttggtgcaggagctgttagccttgccgccctgcagacttgaagaattgcgacgtcggcctaacataattttggtaactttgtctgcttctgcctcgggtagaaataattcagatttcactctccattttctttaatgggctaaacagccactttgtaatacctgtattttattagacataattctggatattgtttctgcagcgtttttgaaaagacaaacctgagagagcccagctatttaacttaagcaattttaaagttatttgtaaaatgatatgctgtcttttttgacccagttactttataaagctacattctttggcaaacattaacacaacttctccgtgtgtgggctaaataaatattcgggcaacactgattgagcactgccttgggtaaataattctctctccacacatttcctagtttataatgaggagttttcttcgtggtctgaccaaatgtaacattccattgaaaatgagacataaatccttgagtgagggagacgtggaaccagggtttgaggagggttattaaaaaggtgagggtagcagggtgacctcctgagtcccctgctctcccgagccttctctcctctctggaacccatggctaataggggacaggagagagcggaagcagaaagaataagagatatgaaagccagccgggcacagtggctcacgcctgtaatcctagcactttgggaggccgaggcaggcagatcacttgaggtcaggagttcgagaccagcctggccaacatggtgaaaccctatctctactaaaaataacaaaattagctgggtatggtggtgtgcgcctgtaattccagctacttgggaggctgaggcatgagaattgcttgaacctgggaggtggaggttgcagtgaactgagatcgcaccactgcactccagcctgggcaacagagggagactgtctcaaaaaaaaccaaaaacaaaaaaagagacatgtgagccttcccttccctctccccatcctagcctcctctcacccaggtccattcttccactgtcatcccatgatgctctcttgcattttaaagtttggaagcccttattcctttgttttgtttttgaaatacaaatatcaacatttttattgttctatagtaatacacgtttcttctatagtacattaaatcacaagaggtaatagtgtatctactaacacctatacttttgagtagtgttgagtgtaaatgatattttgaaatatctgcagtaactgatgtgatatgcaaacatctgtgatttcttttaatttttattaattttcattttttaaaaaactttagtttctggggtactcgtgcagggctgttaaataggtaaatgacatgtcatgggggtttggtatacagattcttttgtcacccaggtcagaagcatggtacccaataggtgctttttcggtcctctccctccttccaccctctaccctccagtaggccccagtgtctattgtttccttctttttttgagacagagtctcactctgtcttccaggctggaatgcagtggcaccatcttggctcactgcaacctccacctcctgggttcaagcgattcttgtgcctcagcctccggagtagctgggactacaggtgtgcaccaccatgcccggctaagttttgtattttgcgtagaggcagtgtttctccatgttggccaggctggtcacgaactcctgacctcgagtgatctgcctgcctcggcctcccaaggtgctgagatcacaggcgtgagccaccgcacctggcctattgttcccttctttatgtgcatgtgtactcaatgctcagtttccacttacaaatgagaacatgtggtagttggttttctcttcccgcattaattcatttaagataatgaagctcctgtccttgacccaatctccactctaccgtttgatgtccagtgtggactgcccctctgaaagcccttcactgcggcttagcctgtggtggaaggtgtccaaggtggctggaacacctcctgctgggggtgtcagtcttggctctcctgttttctgcctgtgcaatggtgggtaggtcccttgatacctcgtaacctcagcatccctgtgggtgataaggagatgataatagtctcttcccgatgggggttaaataaaataattctcggagtatgtgaagcagtacatgtgaagtgctcagctttgtgtctggcacataaggaagtggtcagtgtttaatgttagggatcatagatgctgataaattgccgtttatggcatatttcatgtattgcctcatttaaacctccttgcaatctgtatgactcctgctgatgatggggaatttgagactgtgagaggcttggcaaaagatctaagctgtgaagtatctggaataggattccaccttcagccctgccttaatgaagaccatggtcttgccacattgcatctccccaagatttttatggttctatttttagtcacgttggcctgcgttggtaaatttacctttcctggtccttttgagtaactatctctggaaaggattaagtgcagtgatcaatcagcagcaaagtcctggaagaaacccatttgttagtctctgggcctccccaggccttatcagggcttagccttcgagcagtagcaacacttgcacctgcagttactaattcctgtggaatgaagtaggcgggcccgaaatgtacagcccttatccagtgaattctcataggagcaaaaaaaagtgttttctttcccccttggagttctgtttcttcttaaaattagctatttctcatacacaatagggacatattcataaaaaagggaaaatactccaaagttgaaaaaaagattgaaaaagaaaatcctccaatatatatctactcttagcattttggcacatattcttacagtagtttcaaatgcccaggccattttgttttattttgttttgttacaattgtggcatatgtactcgtgatggatttgcttgttatctctaaattaattctcctcctgcaattcaaatattccagagatatgtatatttttaacacattgttaattatcccatatggataatagtttcttttctctcttaacattttaaaagcatgcctccaggttgttctagacggtcctgaacagtgctttgaatggggacatgttagtaaaccaatgagaggaaccacggtttagttcatcattctccttctaactgtatttttaggttgtcactaactcttttcagtcgtcatttccatggccacgaacatctttggttctaaagcatttttcccatttaaaattatttctatgggattgatttgccagaagtagaatttctaggtcaaaggtacaaacgcttgagaagtcctgatacatattaacttgggccagaaatctaccatgtaattgagagcaccttgagcttggcttcagagccaggatgaggacaggaataagtgggccttttgatttgaaatgttgagatacgaatgtattctagatgggccaaataaccagcttattttattttaaagtcgagtgaattttctgcctcactaatgtgcatgtcttcaaagacaagtagtgggaacggagtggggatttgtcatcccatagaatgccaccacatggaatcggtcctgaggcttctgaaagcagttccaaatttgaatgtttcctaagttagttcttgcggtacagcgcagacaatattcttcctcgacaatagctgagacccaagtgcctgggcgcttccaggtcataattaacctcttcaaaataagagcaaagaaaggcaggaaaaggtcctctccattccagaaaggagaacaaagagggggaattctaaccctcttgccacctctgttctcgtccgttccatattaagaagcattcaaagactaggatgccattttgcaaacgtctcattctccctgaatggtaaggctccacgctttagcacaagtggtacaaatctgccttccctcattcttttttgcagatcatcccgctccccacccctttctttatcatggctcatttggagcatctgtgcattttttaaaggctggattttctttctgttgccattgaaacattgcatttgtacaggagaactacttaatggcacagtttgttattacatggaattaaatacaacctatttaaatcatgtaccgtgaaaccaaagagctgtgtatggaaaaagcctcatataacccagtttgccaggtcctaactcccttcatacatatactaacatgcaaaagacctcctaccttttttttccccttctgtttctctcttggtataacactaccctgtttttgaaagtacttgtactgctaatatattctttaaagaagaggggggaaacctgttggtcccctcataaaacagttaacaggaagcccaaggcatctttcagtgccatttttggctgatgtttggaatggttccatcaatcactgctgttcatgtatagctggtttttatgtcagttaaaccatcttccatcaagttggtgaagcagagtcagggaacaagatgaatagcaaaacgtcttctgtggcatggaaaaggctttgcttttaaatgcccgtgttgatttcttaatattttcaacttcctcttctgaagccagttccccccgaccatcagtcatgagtccgttcttttaaccttgttcaggtggcgtggggcggtgtgtttggtggggagtgatgggtgcttgcctggaagtgcgagcaattgatcagctgatgaggggtatttattatctgtccctgactcccgagagaggaaataaatccttggaccccagagtgattttcggagccacaagaatgcaagatgtcctgtttccagtcagaccatagcagtatcagtctgtgcagttggaatcttgcatggggaggtgtttttatttcacacaagaaagaatggcacatctttccttgaaagatgtattttgtatatcttaatgtcagttatgtttacgtgtttgctgctcagaaatcaacaggatttctgcccttccccagccccctttttttcagcccttcagagaatatttgttgagtgcagtgtgtaaaatcatggcggtgccaagagggggtgtgatgggtgtggccgcccccctgccagcaggaggaatctgttttcactgacattgtttggaatcaccaagcatggtgatgataaaaagcagttaaactttggtcacttttattaatacttttaagtccttagcgaacaatgcacccgttattacttgcacctagtggacatggttctcattgctgctgcccacctttcttttttttgccatgggtgcaaaagatgcctctggggatcccagaggactcagcattggtaaggatgcagtcctaatcctgaaggagggtacagctgaccagggaggtaacacatgaatgcagctgatagggccagttggacccagatttcaactgcaatctctatttccttcggatctgttgcatctgctcaaacactagttctgcaatttcccaacacctgccccctgccccttataaaagctcatggttccatgtgactttccactcctgcgtctctggccttggggcaggtcagtccgtggatcacctcactgtcctagggatgctcttctggtccacactgtgcctaccttggatatggagttccacttgttcccttacctttcacccacctgtgctcctcacccaagcaggcattgatggaggtctcatactttactgaagatgtgaggaaagaggacacttatgtagaacccaactgcaggtggagccttggcgatccatagccctctgtaaagtggggattgaagcacatatcttgcaaggcttgggcattgattgcagggagtaatgtgtatatgaatcatcagctatgcaacataatgctgatgctaagtactaacattgatggagtgttggcatgagctgggcagagtgctccatcctctatgtgtgtattagttcattcttgcactgctataaagaaatacctgagactgggtaatttatttaaaagacacctttaattggctcacagttccacaggctgtacaggaagcatgatgctagcatctgcttggcttctggggaggcctcaggaaacttacaatcatggtggaaggcaaaggggaaggaaagcatctcacatggtgcaaacaggagcaagagagggagcaagggggcaggtgcaaaacacttttcaacaaccagatctcaggagagccaactcaccacacagcatacgtgctaaaccatgcatgagaaatctgtccgcatgatctaatcaccttccaccaggccccacctccaacgttagggattacatttggacatgaaggctgggtgcggtggcacactctgtaatcccagcactttgggaggccgaggcaggtggattgcttgagctcagtcgtttgagaccatcctgcacaatacggtgaaaactcatctctactaaaatacaaaaatgtagccaggcgtggcggcacatacctgtagtcacagctactcaggaggctgaggcaggagaattgcttgaacccgggaggtggaggttgcagtgaggtgagatcgcaccactgtactccagcctgtgtaacagagcgagaccccatttcaaaaaataaataaataaatttgacacgaaatttggtggggacacagattcaaaccatatcaatgtgaattaaatgacatcattcagtcctcaggacaaccctctgaggaagtacttatgccccccggcctttttttttttttttttttttgaggcagagtcttgctccatcaccaggctggcacgatcttggctcactgcaagcttcacctcctgggctcaggtgattctcctgcctcagcctccggagcagctgggactacaggcacgtgccaccatgcccagctaatttttttgtacttttagtagagatggagtttcaccaggccagactggtcttgatctcctgaccttgtgatcctcccacctcgacctcccaaagtgctgagattacaggcgtgagccaccgtgtctggcgtcatgccccgttttatagatgacaaggcatggaatggttaaatgtctttcccaagctcatggagtggtggcggtggaggtgttgtgaatgtgaacccaggaagtccgcctccagagctgcaggcattaatgcaaagctgcactgcctcacgaggtcgctgatgcactctcattccttttcctccagggactcctgcactttgccaggcgtgggccagaatgccactcgtattgtttatcttaatgcttagtgatagtagctacctccagtgcacgccgcattagcctctccaatgagtttctcctttattttaaatgtaaatctagagttcccttaatccccttaatttttagtacgtggctctgagggcagaaacattttcaggagcagcctgggctgagtttttaatgtggcagcagcctcggctggtttcagcatgcaggtgagaaggccgttcatctggaacttgggctacccaacagtgcaagtggggagatcagagcatggaaaatgtttttgtataaacttaggtggaccaaaatgatcatttcaacaacatttcggacttgattttttgtatttatatggcccctttcttcccaagaattgaaagcctcaaactagaacgtggcttttgaacggtgaacattccacaaacatttaatacagagatggctgtggggtgggggctgggggctgggggcctggaaggggagaaggggcaccagaaggagaaatgggaggaaagggcgagtgagatagcaaagagaactcagaaagtaataaagccctgcagtaatcagagggctgaggccaggtccccagtgagcggctgaacacacagtgattcaaacccactccagacctgtgttcttaatcattaccttcacctggagggacagacctggccttgggcaagccacccccactccctggctctgtgaccttggcagctgactggccctctccaagatcagtttcctcatttgtgtaacagtagtaatctccaatttagggggctgtatggatattaaatgagaaaacacacacagatcatttctttagcacaacgtctatctggcacattagcgagagctccggaaatacccatgccagggtcacaagctcggttctggagctggatggccggggtttgattcttaactctgctcctttctagctgtgtaactttaggcaaataatgtaacctccatctgcctttgttttttcctctgtaatagaaggaacaacaacgaacaacattttttttttggcaagattaagtgagatcttccatttgacatgcctggctaattggcagtgcccaacagatagaaactattggtattgtaaggactgcttattgggtacatatgctgtgccatgggaggtggaggtgctgtcatgctgaacccctattaacctcaataggaaaggcaccaggttcaagagctgaagaagacactcagagccaacagatagacatggggttttattaggaggttacatataggggagagagtccagtgatggcgggctggatagtacaactgcccaccttacatacagaaatggtccagtggcagtaggctggacaggatatccacctccctacagtccagtggtggcggtgggctgggcaggaaaaccataaccacctgcaaatgtcatgtggtttatatcacaccttcacttaacaccctccccctaacaacctctacctggcaatcttcatttaactccaaactcaggacctcaatcccctgtttggcctgtgttccacgggacaggcatggggcacagatgtctgttatatataagggacaaatctctgggttggtcactcctggattccccagcccggaccacacattcaggtgcatctcccacacaggatcattctaagggtatgcttacgttaccgctattggggtgtgttcaccctgcaggtgcagagatggcaaccgaggcagctgaggatcagggagtggaataacttgcctagttctggctcttcccatctaatgtggctgcactagatgctgttaggaggaggaggaagcctacttttgttttttacccagtttctgttcaaaggtcgtatttcatggtgcctcatcacagtatgttcttatatgccctggcaaacagaaggtgctcaataaatgctagttcatctggtcccttaatgaatactctggcttcgtcatcttccctaggctttggttaatttggtgccctcttttgccatttctgcaacccttattcattgctgtcaactgctcgttacacagcattgcctgtttcactctgtacaggtgccaggcgtctctcagcttctcctctctttcccatccaactgagcagcaccaataaatagataagaaacctgaaggtctacatcaaatcagcttctattgctgcaaaactcttctagctaacttcattctaaaagctgtctgaaatatatttacttacacccgagaagattcaaaaacattaccgctgaaccccgatgctttgggaacacatggtgtccttggccacttccttgcttgttaccttgtccaacagctgattggcatagtacagatgtagacatcaagtaattctatcgttaaaggattagtcagcctctccctactccccacccacttatctcagtaaggtttagtcaagaagttggaaattaatggggaaggaaggttttgggttatgtgtggatttcatttatccatgctatctcttccctccattagcatggttaattaagagttgtcaatacatctttgttggagtatttgattattttttcaacagggaagattagaatgaagtcttcagatctggcaagtgtcatgggacttgtaaagtaaattgcaggttaagccctcattttgatctctgggatgagagcaagcaccgtttcattgacatgtcatcagctatgatctgagggagcacacagaggtgccctttggggaaagaggggcatcttgcacttgtctcccacattgaaagggtttattgcacagtgagtgtgtgcaagtgaacaaatagcagatgggttagaatggacagaagctagctctgagcacctcctgatttatgctttatttaaaaaaaatcatatgtatgtatatgtgcatacacatacattgttttgtatatatttgtcagatggaggtgtgtgtaaacaaataacagaaatgagttaaaattgacaagttagcttggtaaacatcttgatttataatttattaaaaactacgtgggtatgtatatacatacagacacacacacttcttcaccacctgaacaaaaatcccttttgaatcatccttcttgccttccaaacaagtacactagcaaacacttttcccagatggcaaatgactatgcccgttaggcatttcttttagcatttgtgttgacaatggcctttatttttccttctacttaagggctctcacgttctagaatacatcttaccagcgattaattatgccttgagattgccaggagacgtagacgagcttttattgttttagccactgaatatacctctagataacacaatacatatttacagtgacaagctttgtattatttataggattatagcaaatcatcaaaaaacaacccaaaaagggccacttagaccaacatccttatttctccctcggcttcagcattgaattatgcatgcattacaaatggcaataaggagtaaaggtcggtttagaacaacacagattgcaaaattacaccatttgtttaaacaacattcattattgattattcagcataggggctgatagaaacgcaaacagtggcagtaatatcatctatttacgtaggccctttataaatgtgggaccataccctctgtttagatcggaacaattgttcaaattttccagctctgttttgcaagaaagtaaagatgaatttggcatctacttccttgtgtcttttaatttttgaaagatttttggtattctccctatatcactgaagagagggaattggggttcagatggattaagtaatttacttaaggtcctgcttctaaagttataagtactctttccatcatataacacttagcatgtctgaagccagtaatttattaataatagtaatgataataattataaccatatctaatacatattaactcttattttaccagtccatgcacaaagtgttttgcatgtgcttcgactttcagcctttacagaaaccctgtgaatagacattattatgatgttcgctttatagctgaaactgaggtgcaaaggagttaggtaccctgctcaagatcactgggttagtaagtggcagaactggatgatggaagtcatcactgtgttccagtatctgcagaagtgtcacacttttgtgctttgaccgtcttctcatgacccatgaatgccatgatttcacaaacctgttcaaacagtattggtttaatggttgattcaaatgggtgttccaaagatatcgtaaatatatttaggatattagaaataagatatttaactttactaacataaaccttcaatttagttttaaagagtcttagagcagcataaacaacatgactttcaactaaaatggaatttactaaataaaacccaagagattaattgtaggagctatgtcctggtgacttgggaaagaaaaatgtaaggtggtaagcttacgtacatgctttcggcatacacttcccacctccagcctcgcattcccctggtacaactcaacaggcatttcattttgccttacaaattgagtgcaaccgggaagctcatcgcatagctgcttactcagaaaatctggtgtagtggcttagctagcataacttttgagaggtctctgtgtgatggtcttttttaatgtctttcgtgaagaattcttcttttttttttctgagacaatgagttgttctgtcactcaggctagagtgcagtggcgtgatcatggctcactgcagtcttaacctcccaggctcaagcgatcctcctgcctggtaggtgggactacaggtattcaccaccaagctcggctaaattttttttgaaactatttgtagagattggtggcagggttggagggcaggtctcattatgttgccagggctagtctcgaactcctgggctcaagcaatcctcccacctcggcctcccaaaatgttgggattacaggtgtgagccaccacacccagctgaattcttctcttgatcattaatccccaccccaccccaccccagaaaatccatgttatctttttgcttagaggttcaccacctctgttccatcacttttctttttcttttctttcttgtttttttttttttttttgtttgacacagggcctcactctgtggcccaggctagtatgcaatggagcaatctcagctcactgcaacctctacctcccaggctcaagtgatcctcccacctcagcctcccaagtagctgggaccacagcctcctgagcacccgggtgcatgccactgccaccatgcctggctaatttttatattttttggtagagatggggtttcactctgttgcccaggctggtctcgaactcgcaagttcaagcgatctgcctgcctcatcttcccaaagtgctcggattacaggtgtgaaccaccacatctggccaacttccctttctaagagccctcttggggctctgatatgcacctctcatacctcagccccagtcagggttgttgaaaacccactgtctgcccagaggctgggagcacatcttggtctgcctggtatggagggctgggaggaggattgcaggaactgcttaagaggcctcactttgcaagagcagttcaggatgtgtttccagcacagtttccaacatgtgccacccatggcttcccctttcatgttcctggcctttatgctaagttctcacattgttatttttacaagtcttttccaaggcctctgattttctagaccatttaatgtttgccataacccataagggtataactgtcttggcacattcagatcccccgtccccctgctgtccttctagtcagtttctggcacactatgtttatgagcttacagaacagctcctaggttttcttacttccaaaacagtgggcaagaacagctaccttttagaagcaggaaaaaggaacataatgaataaacctaaaggatttaaaaacttggaagacactaagaaactatattgccgagaaagagaaatgtaaattccgctggataaattagcgtttgcggttacttctctctttgttgcttaagcagaggagaaacagaagtcatagcaaagagagaggtagctgcaaaagctaatttatccaaaagaatttacatttttctctcttggcactatagggggcatgtttactctcctgatgtcttttggggaaggcgaggcacaaaagaagggcatcttcttccttcacacacacaccccacttaggaaaatacgtacacttgagatgccagagacacacccaagtagaacacatcccaagaacagtcaataataataatacccatcatttattgaacatccacaatagccagacatttttctagttcttataaatccatgtactcctcccagtagctttatgaggtcttattattctcattttattgatgaagaacttaaagttcaaagaaaggagtaaatcacgaccaggcacagtggctcgcgcctgtaatctcataatctcagcactttgagaggctgaggtaggtggatcacaaggtaaggggtttgagaccagcctggccaacatggtgaaaccccatctctattaaaaatacataaattagtcgggcatggtggcatgtgcctgtagtcccagctgctcaggaggctgaggcaggagaatcactcgaacccgggaggcagaggttgcagtgagcctagactgcaccattgtactccatcctgggcgacagagcaagactccatctcaaaaaaaaaaaaaaaaaaaaaaaaagtaactcattcaaggctacacatttactccatgaagtgagcacacttcagacttccagtcttgtgtggcctgtctaccacaccatgagacttcatgtctctcctaaatgaggagaaccaaagctggaaattgtcaccccctgtcagcccacagcactggtttctaaacctactggcctctaccgcttcacttctcactgtaatctctctgaccctaccttccagcttctcttgagaacttgactcttaaattcattggtgagaaaggaaatttttgctccaataaactgggtagctcagtccaggagagaaatgtactggactcagacttggaggacagagctttgtgaccctcctaggcaatgtaatgaccctctcctggcctcaattaactgaggccaggagagggtcattagcaaactgtcctttgctaaatgggactaatgggaagaatagtgtctgccaaataaggtggttgaaggattggatgagactgacatttcatttgcatttagtgaatacttgttgaatgactgaatgaatggttgatgtacagaaacatgaacagagagtagagcagaacattggtgaatggtagtagattgcctcagacgcccccctttagaatcacacaagctgtcatctgtgattgcatacctgtagaagtctctatcatttcgtagtctatgtaaatgttgaccaactgagttgttcagtgtacagactgaacaaccatacagggaatccctaatctcctgcactgtgagtcaaagagtcagacaggtctagatgcatttgcttcaggtgaggccaaggcagtctactcttaatggcacattaggctttggacttgaggccgtgtcttttacatttcgcagcaatcagaaggaatggggtcgccccatgaacttcttaaccacatacaggctcgtggcgtggggtcttcatctggctactagattgtttaaagaaggatttttgtgattcttctaggctgacacattgcctgtcatctgttgtttttctaatcttctagtaaacatttggaaagtgaaggtttaggcatgtatgtttctcttatgtaggaaggggaaataaggccatgagattgcatgagttttctttccaagtttgtgcagatctgcacaatgattgaaatatttgcaacctgtagagcagcagggtatttatttggcagcaaacagtattgatggattcggggaatgccatttgacagttacaggctcccgtgaggcggtgcaggctcctccgagccagggatggagctggggattgagtgacacaagactctttgggtatgtctcaaacaatataaatcaccagcaaaatctcactcctacaaggagaacctgcagggagctccgtgggaggcactgctgtttactctcctcattccccactgcaaccacgcaattaaaaccaaggaatggaatctgatgtctaccgcagcggttttttccatctccattccttctgcattgggaggcttaaaaaaaagaaaaattagatcccagattctttattcttttggaaggatttgaaacgattatcactcatgctctgctgctttgaatggaaaagtgatttgataactttcaaaactcttagccttctaagacttagattctggtactatctcatttatgtgacgtgggacaaatagccactctcttgcataggattttcttttctttctagaaacaggaactgagtatgtttccaatatttttttatttctcctaaaaaaatcagagactatatatataaaatctcacaaactttgtttcccagaaaaacaactatatttaaatgcagctcatactgtatgtaagtatgatgtaggaaaatctgttaattgtgtgacaattatgacttctgagctgctcatttattaaaatattctccctataattaaaaatattttatttcggagacatggctccattaattgcacatttcctaatgaagtttgaaggaagatttaaaaatcatattagccacttgtacaaaaacaaaccagtcatatcatagcattaataacaaaaaaattccactgtttatttaacgtaccagcaaattctaccgtatattgtttgctctccgtttggtgggactaaaaagggatttaaaaataggctatatacactgaatgtagtttcactggaagatttaatgccaacatgttcttttttggtattaacatattgcattggtgtgaaaactaaaatgccttcagcgatgatcttttcctttggaaaactagattcccactcggatgctacgaggggtaatctgtgctaagtttatggtgtgtctgccagggctctgctttaaaaaacaaaacaaacccttttggaggccttgacagttccatggaattcctaggaacagcctagaaggtgaatgatgcagcccagttgtttttattctgagtttggcaaaaatgatagagaagaaaatgtacttttatgtgttcgttcgacagttaaagagtattccagattcctccctccaaaaaaaaaaaaaaaaaaaaaaaaaagggcatattccctagccaaggcccacatggcttttctttactttaagtactcctcatattatcttgaccttaaagtttacagggtaaaagaaacatttatggaacagttaagaccagttagaacataacgacttgcctcattatcacactccacaaatctccactttacagagttcacttccctgcctgctttaaacatgtgtttggcctgcaaacagtgttactagtgctcgcatatggaaacagagaacttctcattccttacctcagacgtgccaaaaataagaatctttaagaactcataaagtaatttagcaccacgttaataaaagaagcaccattttgaattagttctgtaagtatgtgtttgagttagaaatagagttttaaaaaactgtctgttcatatagttcatctgcttaataagtaagcagctctttcaaatcaccaagctcaaataaaacaaacaaataatgggacaattggcaaaactctaaaaagtgatacaaaagaccaagggatatttgaaaaatgtttaaagttattagcagagaagacacaatttagaagagagactgtattccattttatttttatttatatttatttttgagacagagtcttgctctgtcacccaggttggagtgcagtggcacaatctcggctgactgcaacctctgcctcccgggttcaagcaattctcctgcctcagtctgccgactagctgggactacaggcacacgccactatgcccagctaatttttgtagagatggagtttcaccatgttggccaggctggttttgaactcctgggctcaagtgatccacccaccttggcttcccaaagtgctgggattacaggcatgagccaccatgttcgaccccatttttataaatgtaaaattaacttaggtttaaactattaatacacaaggttgagaagtatagaagtgggcattctaatatactgtggatgggaagaacaattgattttcatagttctgagatataatttggagatctctatcaaaagttttataaactttttttttacctaggaatttcatatctagaaaaatattgtaaaggaatatttaaagatatatccacaaatttatgtacagtgatgtttatgcttatattatttatagacttttaaaaaacttaaaatatttaacaattgagttattttatgatgatctaaactgcataggataaaatcctatgcagtttacagaaatgtaaactaagtgcttcgttaaatgaatcctagatcccgtgccttctgactgggtgagacctcccagcaggcgttgccagagaacttacacaggagcgtttctgctggaatcagctcgatgcctcttgaggacagagactcccagaggaaggagcaggcagccatccttgctgtgctgcagcctccacaggtgacacctcctggtgtgggagggacccaggtgaacagggtctggagtagacccccagcaaactacagcagtgttactgggaagaggggcctgattgttaaaagagaaacaaacagaaaacaacaacatcactaacaaacaagttcccacaaagaccccatccaaaggtcagcagcctgaaagatcgaagccagataaattcacaaaaatgtaaggctcatttacattacaggctcaggcctgtaatcccagcactttgggaggccaaggcgggcagatcacttgaggccaggagtttgagaccagcctggccaacatggtaaaaccctgtctccactaaaaatacaaaagaaattagctgggcatggtggcaggtgcctgtaatcccacctacttgggaggctgaggcaggagaatcacttgaacctgggaggtggaggttgcagtgagccgagattgcaccactgcactccagcctgggtgacaaagctatactccatctaaaaaaaaaaattagttatctctgccctttgggaggctgaggcaggtggatcacttgaggtcaggagtttgaacctagcctgggcaacatggtgaaaccccgtctgtaccaaacatacaaaaattagctgggtgtggtggcgtgcctgtaatcccagctattggggaggctgaggcaggagaatcactcgaacccgggaggtggaggttgcagtgagccgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaagctttaagtgaaattattgatattcgaagtttttttttgaatgtttaaatcatttcacattcacattttttaagtaaaatgaaacaacttgacattttagcatagaatgtttatatggtggccaaaaaagcagattggtatcatgctttatgtgtgttcattctagtcctgcacgtgtagaaatgtaagattttaatgtgtggtaaggtagatagatagatagatagatacatacatacatacatacatacatacatataaaattaggtaagaggatacttttaatgtatggtaagctatgattgcaccactgcattctagcctaggcgacagagcaagaccctgtctctaaaaataaataaataaataaataaataaatattttgtaaaaggtatcatagctgtataaaaagaaaagactaaaaagaaagccactcaaattccatttctcttctgcagatttttttttagttttgtatttcatctgtgattgactgtgtatgtatttttgcatatatacctgcaagcatttgtccttttaaccttaggaaaaaaagtctgattgcaactacgtgtttgggaatcagggagactatggaagaacaatctcagatctcagcttgaggctccacttgcaatatcacaatttctaaaacatgttgtatgtgggcccatttgccatgtgtgtgtgtgtgtctgtctatctatctatctatgtatctatctatctatctatatatatatatatatatatatatatatacttataatgtggtgggttctcgaatcacagttgtaattcacatttttctccaccaattctgataacttgcattaagaaattgactgtgtaagttaaattttagatcaataatgcaaattgcaagacctagtacaggccaaggcctcattatatctgagtagggctttaagaaagcaagaaagaatcgcttgaacctgggaagcggaggttgcagtgagttgagagcatgccattgcgctctgctccagcctgggcaaaaagagtgaatgaaactctgtcaaaaaaaaaaaaaaaaaaaaaagaaggaaagagggaaatatacatcctcctatccagggtgaattacaaatagtaccagttggttgtaagtggatttaaaattactttttactgctaatggggcatctgtcttcattcaacaaatatatttcggtctctgttagatacagtgtatctctgttagatagagagcattctgttagatacagagaatctctggtagatataaagtattctgctattctgatcttcctgttagaagatcagatttacagaagtctacatttgctctcaagggaccttcagtctgtttggagcaatctctttattaatttatttattcagtaaattttattcagaaccagctatatggcaaaccctagtccttatgctgaggtttcagagatgataatgggggcagatgcagccattcagttgacttcctgtggacaccagagatgacaggcccctgtccccagcttaccatccagcatataaggcatatatgcccctttccatgaagtataatctaatgagaacagttggagaaggtcaggcaaaggggacaggacaggaactcaggaggaggggatatttagacttacagacctgccctacctaaggtcccacagatggtctgtgatgacagatagcccctggactgctaagactcggatctttaaatataggcccatctgggctgtggggaggtgacagcctgagaaaaagtcattcttagatgcccttactctgttgatcataaaagtaggagctgaaattctcatagcctgagaagctatttgcagcattccctgagggctttgaaacactatcaaacaacaaggagagacaaaacagtttttagccctgctcaactctcatgggcttgccttattttttcagggcatgctctgtctccatcccttggctctgctttccttacattggtcttcttgggcatccgtcttccattccacagtgtagcaagccagaagctgggggaaacatggtgcgtgcctgtaatctcagctactcgagaggctgaggcaggagaatcacttgaacccaggagatggaggttgcagtgagccaagattgcacctctgcacttcagagcgagacttcctctcaaagaaataaatacactgtgtcctctcagcaagaccaggacaacagtgattctctttcctcaaagttccaatcagtgcccagggcttcatgcatattggacagacctgagtcatgaggccatctccgattggtccatccagggccatgtgctcaccccttaattcaggatgtggggtccggctcccctgaagtgcacagagaagaggggttgcccaaaggtgaatggggagaaggggatataagtgcaggacaggtaagaacagcaaatgctcattaacaccatgcagtgatgaaacgcctcttaatcaacccttgctggctgcagttgatttgttacttaccgtgaggttatcatagctttgcagagactttgtgatggggctgtcaacagagagaaagagagagagagaaagaaaagaaagaagtgccaccagtccattttgttccactcaaatgtagatcgtaatttttaggtttgtaattactgatgagaagaatgcctgagccagaacttcccagagatttatctgccacttacctggagtaagtagaaaggatatcagttttccccagtacacctgcctccaatgaagccaactctcaggctctagaagtctctgccttgggatggattcaccagtgtgcttctcaggctggccagtgtggaagcagccttgctgtatttcatcctttaaaaatacagcctgcttgccatctcacgacttttcccttaatgcaacaaagaaatatgtgtttggctgtgaaatctttttttttttttttttttgtttttttgctgtggagcgcaaaatgttcatttatctctggatggtttgtttctggccacctgccctaagtgtatctgaatattgtaacggtgatcacttcttgagtcttggtcattacgaagtgacatttggcatgaatttgctcatcaccacagagggccccagggacccacttgggagaaggtgagttatagcccacaagataacatttctcctggtgactgtcctgaaagcctactttgggccaccacatcagtgtgttgggagatgagttaagaggttttattcttatacatgcggaagaattatgccttcttgagccatgctcaggagatgtcagccttttccattgtctccccgcccccaccgccagccctgcttaaattatcccctctttttaaacaaaatatcctaatcttggaagtggcatatcatgttccttcttttttaagagagaaggagaaattcctgcagatcatcagggactgaggctaactgaagctttggaatggatacagtgctactctcagctgaaagcacaaatcacttccatcacgtatatgagattcctcttgcagcactgcagaggggtgataagcaagagttgatcgatgacagaacacccacccaatttcttgactcattcttcaacgggcagggtctatacatgtggtatggctgcaatgtttgttgataacccctacattcacaaaacgggcgcatgggaacttgtttgctgccttctgccatgtgaggacacagcaagaaagcacatacaggaagtagagatggagccctcattagacgccagatctgctggtgccatgatcttggacttcccagcctctagaactgtaagaaatcagtcagtatctttgtttctttcctttctttttctttttctcctttcctttctttttctttttcccctcccctccccttccctcccctcccctcccttcccttccctttctttctttctttctttttttttttttttttcagacagaatctcactccgtcgtccaggttggagtgcagtggcacgatctcagctcactccaacctctgcctgcctggttcaagtgattctccttcttcagcctcccaagttgctgggattacaggtgcatggcaccatgcctagctaatttttgtatttttggtagaaacggggtttcatcatgtaggccaggctggtcttgaactcctgaccctgaggcccaccttggcctcccaaaatgctggaattacaggcataagccacctcacccagccaagaaattaatttctgttgaatgtatgttgttatagcagcctggatggactaagaatcatgatgaaaagttgggttgctttcatatttagaaatatcttggaacgggcaggcgtggtggcacacgcctgtaatcccagcactttgggaggctgaggcaggtggatcatgaggtcaggagttcgagaccagcctgaccaacatggagaaaccccgtctctactaaaaatacaaaattagccgggcatggtggtgcatgcctgtaatcccagctacttgggaggctgaggcaggagaattgcttgagtctgggaggcggaggttgcagtcagctgagattgtgccgttgcactccagcctgggcaacaagagcgaaactccatgtcaaaaaaaaaaaaaaacaacaaaaaacacgaatatctttttttgtcagctccatgagggcacaaagttgtatcagcttttttttttcacagctgtgtcttcatcctaaaatagtttctagcacagaacaggactcagtaagttatttgtcaagtaaatagactccttaataaattgtctatcctgtatccagtacaatgcttggcctaatatacatccagtttcatttaatcctcaaaacacattgatgaagtgggtgttaatccctattttacagatgtgggaattgaggtgtagagctgttgaagaacttgcccagggttgcagagctctttcacaggggcagagcatgggctgaacaccagacctgtctcacactaaaggtgaaacaatttcccctgcatcaaactgtctctgatatgaagggtctacacactgtggtttgaaggtcagatgtggcctgtcatgtttttgtacagcccgagagctaagaatggtttttacatttgtaattgtttgggggaaaaaaccaatagaataatgttttattacatgtaaaaattgtatgaaattcaaatttcagtgttcataactaaattttaaaaacttttattgaaattccagagagatctgaagtagttttattggaacacagccctacacaccttcatttataagctatctgtggctacttttgcactatgccagcaaagttgagtagttgggatggagactatatggcccataaagcctaaaatactctctgctcctttccagaaagcttggcaacccctactatcatctccacgtctgcctttgttcttcttatttgtcccttccctctgaaggcaggatagcatagggtgaccataagactctctggaactagcctgcttgagtctagtcttggctctgtgctgactacctgtagggatgtaggtgagcttttttatttttctcaacctcagattcctcatcaaatggaagaaataatgagtatccactaccttgggttgtatggaatgaaccaagttaacttagctaaactcatcgcttccaacatcgcctcctatgtaataagtgcttgataaatgcaagttctattcttctattctctctctctctctctctctctctctctctctctctgtctccctctctccccctctctctcatagtgatatggtttggctgtgtccccatccaaatctcaacttgaattgcatctcccagaattcccatgtgttgtgggagggacccaaggtgaggtaactgaatcatgggccccagtctttcccatgctattctcatgatagtgaataagtctcacaagatctgatgggtttatcagagggttttgcttttgcttcttcctcattttctcttgccaccagcatgtaagaagtgcctttgcctcctgccatgattctgaggcctcctcagccatgtggaactgtaagtccaattaaatctctttttcttccatgtcttgggtatgtctttttcaacagtgtgaaaatgaactaatacacatagacacatacacacatgtacccacacacacgtaatttttgtatctaagaaaggggagaaatactttttagttgttctttctgcttcatttatgtgtggagtgcttaatgtggtcacacggatattaattgcatgttttcttgttttataattaagaaataaaaatgaatcactctgacttttcgcttcattttctgcatttgcacaatttggatattttattttgtagtctattaaaatgtgaaagtcagtgtaaagtgtcagtagctttcatgagtgttcttaaaggaaggccatctgattggaatgcattgtatctgtccttccctcttgctggggtcagcccaggactcgaggggaatgagcccctgaggaaggctcagtccttggcagcgaaatccaggcatggaaaccaagcctgagacatgagctgcaggacatctgacactgtcttttaagagacctgcctgtgaggtcctcatcctgctccctacactgcttcagatccacttgtccacttgtagtgagggatagtatctgttccacctgattgattgattgattgattgattgattgtgaggcagggtctcactctcattgcccaggctcatctctgcctgccgggttcaagtgattctccttcttcagcctcccaggagtgccatggtgcaatctcaagtcactgcagccttgactttccaggctcaagtgatcctcccacctcagcctcctgagtagctgggactataggtgcgtgcccccacgcctggctaagtttttgtacttttagtagagacagggttttgccatgttgcccaggctcatctcgaaccccttgactcaagcgatctgcctgccttgtcatcccaaagtgctaggattacaggcgtgagccgccgtgtctggcttgctccacgattttcctctatgaattccacctttcccatggtgggaccaaggctggaagtacttcacaaaggctccatttgaaaagtggctacaaataaaagggaaaatatagtattccttaaaaaaaaagtagcattctatttttccccattggtaagtagtacaaatttgagaaagtgtaaatttgaattccttaataatcagatctctgcaatgtgttttgcttttatcatcctgggttgccatcttggccaagtgtagattattctgctcagggtagccatactgagatcctggtgtgcacaggaaaagagctaacctttgtggatgaaattgtagagtcactacctgcatttgctgtagctcttacaattattttatttttggaagacatcgagagcatggtccaaagctgcataggttgcaagtgggtagaggcagaatttctctccaggcctggtggattctaaagctgtttactcttcacccaccatttcctaggtctggtttcttggttaaatacgtggaagagtggatggacagaaagacagattgatcagttctccacaggcttccccaaactggccaggtagaaataagctaagcaaataaatgacttccccattttataattttctgcaagtcacataagccttcatgttgtttatttcttggttttagatttttttaattataaaagaacattattatacattatttgaataattttttaaaattatagagctgtctaaaggaggcattaaaaaaaccctttctattccttcatctaattctatccctctgaggcaaccatgattagtattttgtacttcttgtacatcctccttcatgttaatatagatgtacacatatataagattttgttctcattttctgaaataagtggacacatactccaccatccccaggtagtgtacagtgtgtgccctttcaggctagtatgtacagctttaaatcattcctttacagagctgtgtaatattccacaacccagaggagcagcttgaagccagctaaagtatgtatatccaagtggaattaagagcttcatgcgtagtttcttgattttgattaagaatctttcttaatagatatgtcagacgtgactttatgctgcaagacatagcataggtagaaatttttatgtcacaggtgggcctaattaaccttgattaatgttctgcaaacccggatagactggagactcagaaagggacgcaaaagctagtctggttcccatgttagtccctgctctgtgagcagctgccacacagtcatgctgatggctcctgcagcagccattctggtttgactgtgctcgtgctgccctgtgacatattgtttaacacagtgagttatgacacagggagcgaaatcaagacttcagccaccgatttaacaaactggtgactcggagatcagcagtccggcattgccatcctcatcaaaagctctatctttatctaaaatttattagccaacttcaaacctgtttgccagctcactaatggaagccttttgaatcaatttgctcctctaatttaaacagcatttcaatgtatattgtcgaagcagaaaggagttgcagcttctggccagtagaattaattatttattatccttttcataaatactttccgaggccgacataactgaaaattgctcaggctgtttgaaaacacacacacacagttttccagtggctaatttgaaaaatgtcaccgtattagttttcatttacatctgtcaggaaacatatctatacataaggaagttttttttttttttttttactttcaccaggtatttttttgtggagtatgcatttaattcacatttacaaattggtttctgtttttaactaaagatactttttcagcagaaatgatgtgtatgatgtcatatctaacttttgatctcactggtatttgatgttaagcctcaaaatcatcaaattttttttacggcactgaaaaaaatacataaatctgcttgattggttcatagaaaaagacccctgtgattaaggtaatgctagtttttgcattttctcctagctgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatggctttctttccagtataataaagacagtgcctccttccaggacaacggtttggcagatttgcttgataaaggttggggtttctaagcttggggctcctcagccatgactgaaacgtactatgagcacggcatctaccgggctgttccacatcctccctgtgggactaggggccagggcaatgggaatcagtgcagaaataaagctcatgctgtttgctctgccatgagtaacgaagtcctctgtatctgatcctgggtctcctgttttctgctagcttcctcaaaacttggtagctaactcattaacttacaaggaagagggtgaacgtgtagacccttcacagtttgaaaaatcacctgatcaataactgagattatgaaaaggtaggaatgaaccaattatggcccaaaggctaactccagccagtagccttttatttatgacccgttaaaaaaaacaaaaatgaacaaaaaatccaaagaaggctgtgtgccagagacgatacgtggcccgaagatgaaggtacttaactatctggcccttcacagagaaaatgtgtcaaccctttcctgtttgcgttcaggtcaaatagttgcattgaaaggcctcatcttacaaatgaatcaatatttagtggtttgaaaatatgttgtttaatttggggcgattcaatatcaaattaagatttttaggtttatttatcgatctttagaattacatcaacattaagctaattactttaaattgtgtttttaagtaaccaagaatacatctgtggacgctgttctgtgccatcttgagtcacgtttttaaaacaattacctttgatgatttcgtatgttatcccattcacagatggtttttttcgtccacctgagtttcaaatctgttgtagtcctggaaattttgcttaggttgaaggaatgagtgcgtgtatcttgtcaaaggaaatcacaagcccatgtaaactcgctcttgcttccgtcacctcgtgctttgaaacataaccacagtgtgctgaggtttcacattgttacatcctacaagcgtgcttacctgcatcaccttgctgggctgtttcagcattggaatatcactgggaatctcaagttcccaggagccaaccacgagagcttcacagctcagaattttcaagatgtggatgtaggcagggagcctatgtagtaattcaagtaagcatctcttcttcttgttttccttataggatgatagaaggtcagtgcttgttcaccccagtgaggtggagcctctgaggtgggaggttttctctcatccttgagtttatctttacttcctggtcattatgcaagttaatttttctagcagtgaaaacagtcacatgggactctgcccagcgagggcgttgggaggcctggcggagaagcagttgtagcatcgtccagccttctctacctaacaagggaatatgtgaggtagggtaggacattttggtagcagtcacacagcccaaagagcatggtgaatttaattagtctgccacacctgtatggccttacgttttccgggataacttaacaagcattgtgtgcagccaggtcaggcagatggaggttctaatccaggctgcacacctcatcagccaggagactacagataagtcagccaaacttttggagtaacaagtagctcatctgtaaaacgtggatgttccaatttatgtatagccgcataatacattaccccaaaacttagaggcttaaaacaacaaccattttgttttatcttgtgatttctgtaagttggggctcagtggagtgactcttctgccccttgtggtgttgactggggtcagtcagtggtgctatgctggaggatgaattggactggcacttcagctggtccaggatggtcacccatgggtctggcactttcacgaggatgactgggatgcttggctcagctgagggactcttacccagagccctacacatggcctttcctgcatggcagatatagggccatcagatttcttacatggtggctcagggctcccagaggattccaaaagaaagtaacaggaagctgccagtttcttatggcctggcttaggggttggcacagcatgactgctgtggactaagcagttacaaaacccactcagattcaaggggagcagacatacacctcactttcttctggtagaagtgacaaagaatttgcagccatctttattccaccacagcaggtaataatagcatctccctcattacctatagaataactccaaactttctgatgattaagtgagatatcatgtaaagtaccaagcaccttggataggcaatgggaaatgttcacaacgttcccatttttacctataacagcagtagcaataatgctaatagtaatgatactagtaataaaatcaggataatgctgtttttaattcaccacactgtatgccatttgcttaaaatcagaaaggactcatcggtaaggagtagggtggtagtatcattttggtctgcctttcacccccacaagacaacatccttaacagcagctatgttgaaggtttaggagtgcttgtcattagggtctcatttccaaaatctgggacataataatagatggttactgattacagggatttttgtttgtttatttgtttgtttgtttcttcttgataatctctttcattcatcattccttcatttccactcttctaattctgggcattatatctttgtcagagatagagtcttttagctgtttcttcacctcccaaatccttctcaagtctgttctccgcctgctgtgccttcctatagtgtagctccaattgccttcatccttagaagacctttaatgatatcctatgccaaacttcctagcctccacctgtaccctgaattggccctagcctagttgtccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataaacatttattaaatccaagccatggggatccataggaggaatttagagcagagttgtcgaatggtcagatttgcctttcagaagaccgttctggcagccatgtgagaaaggagggtggggagacctgctgggaaacaactctagtcacccaggcacgaaatgatgagcccttgagcaaaagtgattgcagtgagtacagggaggaagaggaaacattttgatagatacttggtaaaatcaacaagatttggccaacagctctgaaggggatgacaggcgtggtgaatggagaaggaaggacagaaggctagtttgggacttctggcttggacagtgtattgtgtagtggaaccatcgctgaagataggaggagtccttttcagtcatactgaattcatgacgcctgtggggcacccaagtggaagtcatccattggcacctggatttagatctggcactcaggagggatggacaggatagacattgaccagacacaattatattggcatatttggactggagaacccagcatctgacttaaagagtctgcttctcttcaaaattgcttaggtgttttcaaactacaaacaaatacactcccaaaacctcaatagattctcccagtataccctatattttggccaaactggaatcacatcctggtctccccaaacactgcttgctttttgttcctttcttgctcttccttctgattgcaatgaactccccatttccagtccccatcctccaatcccttcatgtccagctcctgctcatcctttgaaacccactggattttaagattccatctgacaagaatgatcactgttccttccagttcttcaagcactttttctgtttttgatgggatttatcacttgaaaatgcatattatagtaatttctgaattcatcctgattctcctactggtttctaaactcttcaggttagaattcctgttggatatccctctggcccgaaattcctgaatgagttaagcaggacacctagaactatgcagaggtaataccttccttgacctgtcccttttctgggtcagtttgcccttcatgatttcggcaggagtgtgtctccttccattctggtgaacacatccaatgttcaatgttgctcatcagggtaagagttctaagtccctatgtcttagagacaggggttatctagctttgtcttctgcattggcttcaggcttcacatccttcctggacatgttcaatgctgctttcgtttcttgggcgagggccctagaatcaccttagacaccttgctctagacatggccccatcgtggtattcccttttgagaagacaaagattttaaaaattctttctcccttaatgcctcatgaatgcccaagcagcacttcatggaagtacactgagtctctactgcttgcagggattaaacataacattctcaacagtggtaagagagcctttcccttctctttggctcgttttcagtttttattaatttcctgtgcttctggttcatgaatcccaagtcatgatgtgaatcagttcagttcagcaagcactgagctcccatgatataacaggtttttttcttttccgagctgtggcccatgcagagtttactgagacttggctcttgcctttatgctttaaggatcctaaagagaagatgtaattataagatctaaaacgtggaggggggtggtgaattcagcctgcaggcatgtgtttgctgcccccacccccacatcctctttttttaaagttcgcataaaaacctggattcttggtttctcttaaaaaactggaaggtctggcacctttgctcccacatttcccgggcgcagcccttgactcaccctgtacggtggccgccccagttggatgatggggcttgtgcccaccgggtcagctcacaccaaccagcccctattaatttatacctggcccgctttccaaattgacattacctggctggtccgtacgcatcccctgcagtaactggctttctggaggtatgtgctgaggatctctttggcttctgcatctcaaaggatgagtgatttagccaggtggagaggttggggcggtatcctgaatgaaagaatagcacagacaaaagtagtgagttgaaaacagaacagcatggcaggctcccagtaatcccatgagtcacgtgttctgcccacatggaatggatggtggagaagggaggagggaggaggttgggccagattaagcagattgtccccattggtccatttttaaatcttccttttggtatttgtcccttaaggcaacactttcagtctcagaaaaaatccagtaaagggcaaaccagtttgggtgaatttctttgtttttgcagcatgtctggtcccaaagtgggacctggagtccttccgacgaggaagtgcagcctcttgtcgaggagtgcactgggaggggaggctggacttctgggctctgctctgcctctaatctgctgcccagcatcagccttagcccagacccccaaacttcctgggcttcattctgctttgcattcatctcaaagttaagccttctggctggcaggggtttctgagacagactgacagtattagcgtgctgcagtttcatgatggcaagaaggaggttaccaaagccgttttcatacaccttaactcatgagtggtagtgagtggccccaggtgggaagcacaggtgatttggagctggctaacctccttcctttggctcttactctcaccagctcttagacttggggtaggttagttagctcctcccagcctcagtttccctgtttgtcaaatggggtcatagagggtgagaatcagagtttatgcagggcatagcactagtgtaatgctgggcagagagtgagcatccagcaagtggttttgacaatgataataattataacccaagcgacacatacaatttaatcaggcactgtgtgtccacagcgatgtcaaggaacaatgcacaaagcagagtttttccagtctcctgatgtttgagccctgcgcgagccccactcttctcccttttctcataactgctgtgagcaacctcaaatccttctggaagtaggttggttatgaattatgaataattaaagaaataaactctggctctgcagctgaaattgggatcgcatggagaaaatagaaagtccagtgtttgtagctgtgatctctcagttgcttgcatgaattgtgctttaagattgtaaaattttagcccattaaaaataaaatctgttgctttccacccacacctggcaatttggtgagggacgggggctaggatatttactgtctgaaagttttagggaggcttttatgaactgggccatctctccttgtccccatttttctttgcatctccgaactctcattaatttttcacaggcttgtgatggatagtttttatttattcacgtctgagattccgttgtgtgaaaaggactcattttataacattacatattcatggcttgggatggatgggataaggaacttattattaatgtgtcactgtgggaaacttactctagttcatttgcgaaccttgttaaattcggtgtggtcagcagacccggtgaagttttggatacattctcttaacagagggcaaagagtttgctgttgcttttccttgattcagtaaaacaagtttaaatcttatttaaatcgtttgaagtagcaatttgaaaggggaggaaaaaaagggggatggcagagattaagtagagagagaagctccgattttcttgttgaatagccgtgtttcctcagcattctgtagatttttggccaggtttgtgtaagggatgaacgactctctataaaatgatgtcaggatcctttctttcctgcccattgccatttctagcattctctccttgagggaagttgcagttttctccctctgtgtattcatccttctgacctgtgctccggattccagggagttctcaatttggagctcataccgacatcacagaattccttgcctgggacaaatagagggaatattaacatagcatcttgtaaatcaaagctgggcagggggtgggggagggcacagtggggaacctggcccaatctgcttcagtgtgagcttggtaagaaggaagcatatgttgcatttagttctctgcaaagacaggcgctgctctctggcagggacagcgtgtagggtttgcatgatttgtggggccgtttcatgtttgcacggtttggcttggcttgggactcggccagtggtcactgcagtttaacagattccccccgggtgtgaaggaaagcgagataaatgcaggaaaaaggatacattttgaaatctggaaattttacataacaggcatcagatttgaagaatgtccaaaatattacgaatcatagcacaacctttgctaacaccgtggaaatttttgaacatggaatttgttaatgctgacttggcccaccatggggttaaaaaaagtgaatttctttttgataaccaaggtgatgatcttatgaagttgatgatggggtgtgaacggtgtgagtgggggacaaagcaatgaaatatcccttaaaatgcatcctctgatgatgtttccataatgccaaacatttgtttctctccaggatctcattggcggtttgctggtattatattgccatttatattggaaaggcaggcagtgcgaaaactgtagtctattaagagtttgtgagtgtgtgtatgtgtatacagtgaaataatatctagtgtaatgtgaagtgacagtcaaaattacagcttttctcttgccgcaagggtacttctctgccaagtatagtaatattgttgtagcagtgttcaaggttgtcagcaattctggcttactctgcagagagccataatagtgtgtggaaggaaggagcttcctgtcaggggaaatactataattttgatatatatttgttggtgccaaactgcaattaaataggaggtgttggaagaaggttttatttaaccagcttgaatttgttaattaattagcaaaaacttatctttggaatgcttcaagaaacagttctatgttgttctcataacttaattttacacaactgtcttttgtttgtatcttacagaaaacaaaataccaccctccgccagaaaagtgcagaataaaaattttccactagcaaaagaaggaaaaaataaaagatcttgaatagtctcatcaattacatcttcttttgtgggtatttcctggtcttttcatgttttgacttctatctcggtgatctgacagacatgtacgatttgcaacaacatctattatatgatttaatttatacctttatcagtttgcagttatgctttacgactcttcaggtgactaaagaaaaagagggtgttttaaagtgtgtgtgtttgtgtgtgcgtgtacgtgtatacatgtgtttttctgtgtacataagtgtgtgtgttttaaattgtttgaaaaacactagtccatctctattgtattatctgagggatgctagctcgttacttgggatagtaacaagtttcttggtgacaactcctcctcccattgtcaaggaagactgaggatgtcaccagagttcgctgtcaatggctattcagatgaaaaataccttctttttgaataagtagaaaaaccatgggggattgaaatagcaataatatattaaaagctccaaggcagttatgtgtgaagaaataaagaacagaacagagagattgtgttgttttaaaaagggctatttaagagtcttgaaaagagtgtgtgtgtgtagggggacacctccctctcatattaagtattttgcaaattaaatgagtttcattctcctataaaatatgagtctaatcacattttatatgattgtaaaatgtgtctacttttgtctctatctttcatggaaaaaagaaatattcccaaagtatattataaaaaataattaataagcaacttttcatcattattttctgaggttaattattaccctaagaaatcaatttcaatttcttcagtttgaaagactcatttgtgatggggtgtttccaaaaagagagttagttaaatgctatatggaagccttcattccctaaagaaaatgcctctgctgctggcagtgatttatccagagctgtctcacccatttatgccccatgccaggagaatgtatggaaaatgtaatagagctattagaatccagtgtagtagattggtaatagtaaggaacaacagttgtcttcacattgttaaaataaaagtgagataccctttaatcttcgcaaagggaaataactcttctgctaaccctcctgcccaacctgagatgaagtatcaggggatgcagtatggatgtattttcctgacgattggtccttctgtcctgggacccaggtgtgagtgcatagggaaaagggaggagaaatttaatcctgtaactatctccttatggaaaacaggaaaccacagatgaatcaaatgaatccgtttcccctctttctgatcctctgcaaaagtcatcaaaatcactctgttctcaccaggcaactggagtttcgtcagctgagtctagagtgttccaggcagttacagctaatcatggcaggctctacccaactgggggaacaatttagctgttgtgggatttccctttaaattaaatatgttcttcaggtacagttttttaaaaccagtttttctcccccacttttaacctactttatcgtccattgctgggcctagaattgcatgtccattggcatggctgacgttatatataaatatttggaattgtagttgtaatgatagatattatatatatttcacatgttttaagattaacatattaacagtttgtgatattcaacaaagaatgcaataacttctgcgaaacaggtaagagaaacaaccagtcacttgatctggatattgagacgttacctgtaggatatgtattaggctgttcttgcactgctgtaaagaaatgcttgagactgggtaatttataagaaaagaggtttaattggctcacagttttgtaagtggtacaggaagcatagcggcttctgcttctggggaggcctcaggaaacttacaatcatggcagaaggcaaagagagagcagcaggtgacatggtgacagtgggaagtgacagagcgtggggtgggggtgggaggtgccccacttttaacccttttcctgtttaggaaaaaaaaagcgcagctcactgccagcgctcatttaattttacataaacatgctctttgaagctgaagcaaatgtgaccgattttcaaagtgataataaaatataaaaacagttcttggaaatatttctgaacagaactaacatcagaatcatctgaatcatcagaattgtgtattttggaaaaatcggattcatcaaatgaatcttcagccaacaactgttcgagaattatgttaacatcacatgcaggaatgctacattttctcggatttgacattttcagtgatggagaactattatattttgtaaatggaaataccactactaaaaacagaaggctataaatagaacgatatccttcgtttccaaagtcgatatgctagagtgatgtgaaaaaaataataaaagcgagatatttcatggcaaagcgatctcagggtaaacactgcacaccagtaagtattcttggggcaaatgggaaaagggttaaaatgaccagatctccagagatctcactcactatggtgaagacagcgccaagccatgagggctccgccccagtgattcaaatacctcccattacggacatgtttcaacatgagatttgggcggggacaaatatccaaactatatcaggatcccagcagactgggtgggtggaggttcagggatatctgggaaggactaagaatagctttttcttttagtagatcaggagtttcctcttacacacaaaaagctccaaatttaaactagcttaagaggaaagggtcattactggctgacaaaatgcgaagttttgtgcaagagtcagcaaagtttctctgtgatgggatatttaataaatattttggggccttgtagtgtttgttgccaactactcaactctgccctcatagtgcgaaaacaggcataaacgacatgtaaaggagcaggcatggctgcgagaaactttatttatggatactggaatttgaatttcatatacattttcatgtgtcacaaaatattattctttcccccccgcccccaaccatttaaaaatgtgaagcatttttagcctgtgtgctgtataagaacacagccgtgtttggcccagcggttatagtttgccaacccctgcttagagtctagctttattcagagcttaaatatgtcatcgaggtcccctctttatttaatcccttagttttgatgatcttttatgggttatattcttcaaagggaaaattctctccaaatggggctgccactggcagacgagcactgtcccatcttggcttgttcccccagtgacaagaagctgttttccccactacccttggcccaaaagccacagggagaaccaggattggcctagttttaggcagacacctatccctgaatcagtcatgtccccggatgatgcggttctctgcagcctgggcagtcaaggctggagataattctctgcttctccacggagtctgagaggccccgttccctaatggtaaaatgaggtccaattttgcaaaaggaggcacctggggaaacattctggacacacaaatctatagcttctaccgtcaatctgctatgatccttttatggttctgacgttgcaattttatttttgcatgtttctagagacatcaggaggggatcttttcgggatgtggcttcaaaaaggagcctgttggatggtctcttactagtggtcagcaaagaacagttcttttgtaaattgcactgcattaagagcattcctgtttccatctcattgatacctgccttgcgttctgttacctggaagcacaggtcaaggtagtcttcttgttccactgatttgatgggggtcaggatgctttcagaaaggaagtgagaagagtggcttagaacagggaaaatgtggccgggcgcagtggctcacgcctgtaatctcagcactttgggaggcctaggtgcgcagattacaaggtcaggagattgaggccaggctggccaatgtgatgtgagaccccatgtctactaaaaatacaaaaaattagccgggagtggtggtgttcgcctgtagtcccagttactcaggaggctgagccaggagaatcgcttgaacctcggaggtggaggttgcagtgagccgagatcgtgccgttgcactccagcctgagtgacaagagcaacactccatctcaaaaaaaaaaaaaaaaaaaaaaggacagggaaaatgtccaggaaggatgtggcttagctgaagatcagcttcagcttgatcccacgggaagctctggagggtgaattgtacagcagagttggtcctgactgagaccagggcctggctgacctatggcagtcagcgatgagccagtgtctgctggggaagagggcggcgtggacatagcctctcaagtggggcaggaaggggtagctgtgagatactagctaattcttacagcttctgggttcaccagcccggcaggagaatctgggttgaggaggcaacatgacaacgtgcctaccttcaccagagagactgctgtcaaaaatcactccatccatgcaaggaggaacgatgcagacacagaaattctctgctgtgagggccagcactgtagtatttactgacctgctccccactccacacctccaagtgcaggtgtacagactgacatcaaacctttcatcccgccctcggcctcatacctgctttccactctgtgacctatttacttcgatggagtcattttcaaataacttttgtttagtgaaactcaaggcttttcaggatgctgtgctaatgtcttccttttttaattgagtaaatatattatacacagctgggtaggttgtttccttgctggccttactgctacaatttgaaaacggatacagttttctttaactcacataggatgaatgtggcatttattcctggtttcctgtggctctcctcctttagaaaacgtatttacatggacgtttttgaagcacttcttaagacatcgaaaaattaaaaaagaaaaaaaaaaagaagaaaaatctcttttccctcccccaaacaatggttacatagtgacaacagtgggttgagctaaattcagctacgtcaaggaagagcaataaaaggagatggattgttctctaagcttcactttattggatattgtaattgacatatagttgtcatttataatcatctgtccattcctgtgaggtgggagcagtaaagttaattgtggcagctcatttgcattaatctcacctctgaagggtacagtaacccattaatatcacgtcatgatgaattatcacaaataacattgaacatattgattaatgatctctgagatttgtatctcgttaaaacattttgttagctctttaaacttttaagccaacaaccattgcgtgtaggaggggtttagagatcatctgagaggtggtggtgggtggtggtgtactttgtagggtcactggtttaaggggttggacaacccgttcccatctgattttcctcttcttcgggagccaagtactttttgttggtaacttccgtctactttttgcaggatagtggtttcttcaaaacagtggcttctttgattgtaaggtggctccgattctcaaatggaatgattttcttaagatttttaaaaattaccccttcaacaccttaagtgctggctttctgaacctcttgcccacctaggcatgcctgctactttgaagtggcaagagttatctttgtctattacatcagcattcctaaacttacatgttaacataaacatggagctcagaggaaatgtgttgtttgagatgaaccatcgtttcaaatgtcacttacttcttgttttataaagtatcattactcttttcttggacacagtctcatctttgaggtgtttgcagattttatctcctgtggacatttctacaaaatcaatcaacaaacttgagcagagaaatcatcatactagccacacacactctgcaggcattaataaaataatagtaaattctctttaaccaagtcctttgcagaatttcctggtagaagtttaaatgcaatagatgcagtaaagaaaagggttggcttaagagttgacttacaaagcttggtcctaacagctttttcctttatctgtttcaagagtcatacgatatttgatctttcaaacttacgtatttcttccattatgtttagtattagtttcgttttctcaagatacatatttaacaactagcaaaatgttggaagcggtctcctctgctgtctatttagggaaaatggaactgatctttctgaaataggcatgcatgtaatgatgatgtcattaatgcttggctagctggtggacttaaacccagagggcacttctgaaaaggggcaaagtgcatctgcttctgctttgtttatagactgtcagccttggatctgtcactccctcagaagggaaggattgaggccaggcaaggtggctcacatctataatcccagaactttgggaggcgaggtgggaggatcacttgaggccaggagttcgagactaccctgggcaacacagtgagaccctgtctctactaaaaaaagagaaaacaaaattaaccgggctgggtggcacccacctgtagtcctttggaggactacttgggaggctgaggcaggaggatcacttgagcccagaagttcaacattatagtgagccactgtactccagctgggtaacagagtgagaccctgtctctgaaaaataaaaactaaaaaaaaaattaagttagaagggagggattacgaccctcatgtgtatcaagaaacaagctccatgaagccccataggatggctcagcaccagaacgaggtctgactgttaagcaaagtcaagtgcatgatggctgaacattgctgggggaagattttgcaattatgcattgtttgtgcctttagccagtaggtaaggacagtggtaccattctgacggactctcggatgcttggttttatggagggatcttaaaacagtaatcggcccatatgtgcagcaacctttgcgcctaaatagctgaggacaaagtaggttgcttacttcaagagcccttccctttctcttctttgtcaggcctgtaatgttcctcacccactgagtatttaatatctgtgttttcacatcaaagaacaagctttctgtctcccaggatagtatcttgtaaagccagcctctttattacttcaccagttttaaggctttattacttgcgacctaaagcctgctagtgaattatgcatgttagaactcacagcaccgtctctgcccactcttttgccacctttttgggggtccaaaaagtacaaggcgagatcgacgtgtgttcattcccatccatggtattaatccttattcatttaaaaaaatctgctaacggaaatatttccattcagctcattaatcaattgtgattttcattcccttgttttgtaaaagctgttgcaataaatacttttttcacaaggcgaaaatccaagagatggatgcagccagcgtaattaattgcacccagttacaggagatcagcaagtttgtgagattcacatgctgctgtaccatatggttgcccagtgggcgaaaaatttgattaatgttttgaagtagatttttttcagcaaatattgcagccccagatgaggtgggggttgtcccccccttttactttctagtattgttagacttagctgaaggaaacaatcctctgatttaaagcttaataatactgtgattcagtgaaaacttaacatgcgataaaaattacatttctctcatctcttgtggatacagaaaaataatacatgatgtcttcgtttgtaattaaggaaaatgtgatcgttggattctaaaacttgattcttgattttttttttcccctaagaaatggaactgtggttttcactgatgcacttttggtatgatttataagtagtatatttgggcagactcttcatactcaaagcagtaaaaaataaaataaaataaaatacaatgaatccacaaacagcttcttcttcattatgtaccctatacctattagagcatcataaaatataactatatgagtatcatagaaaagttaaagctgtctctactctgttatgctaagatatattagtttcataaccactcaatatattcatagttaatttatcctttattttaaaaaaatgtcctgcagattttaaaatcaattttatagtttcttttctgtttttagttagaaagttcattttatcttagcagctccttgtcatactgggcacccattctcttaggatgctgcccttctgacttttttctccaatacctgggagggaattagccatttggtaatacaacgggacaagcttatggtaggtctgacctcagcattcagaaaaacaatgtgaaatttgtaatatgtgtcagaactggcaatcaacgccataaggacaataaaataaaatacatttctccactttagtaaatgaggcttcatgcttcctatggcataacttttttgttgttgttgttttttcttttctttgaaacggttttaaatttctaattgcctaagcaatctatgacactccttcaatcttaatgtctgttgaaatgaactagcatctcaagcagttggagcatcatctttaactagacatcaacctggttttgaatcctttgagttttggcaaatagaaaattcatccagggccacaaaaaatatctataattttgacccagttgtagtctagagagatacttagttcaaaaagaattgtgttatcgtcatcaagcaaaacaacagtatatgctatcatctctgagatgtcacacgattattgctttttttttccttttaaattttttctttgtgtctaaagcagtttaagagctctaagtgtgctctgttttctgatggcttaacaagggactggctcaatcaaaatagagaaggaaaggacggagaccaggccaaaacggccatctcctctgattttcgattcatgatataaatttttaaacaaaaaagttacagtgtttttggtactttcactaggcttctaattttttttcctaaacttaaaaaaatttttttaagatcaattatgtaataattagccacaaaggcacaagaactgtttcagtagtggcctgttttaatgttccattctgaagaaactggtacagcctttctttcctgagtttgagctgaaactctctctttcccttttatcaggtcgctcaaaacagatttttagagtgaagcagttttagggacaacatttaggagaaacatttccctaagattccctaacatttttttctttaatttagccatttctaatgaatattttttaactgtgcaatttaagtaatgatttttttaatgcctgctaccttcaagacacttcgtgtggtcacctccaattatagactaggtttttaaatgaaaaacggaaacacttttaaatttttatttaatatggccggtgaaacatgaacaatatatgatcagttggcaggagacagtgtgatgaattatttatgagtttacttttttttttttttttgctttaacagcacatacatatatgaaattcattaccaagtgataggacgggtaacccagaggttctgatgagggccaggacctcatggtcataaaagtaacattagacctattcctagtaatttgatctaggttggcctgatttttgttgtggtggcagtggtggctgtggttgtcaatttaatggaatgtatttggaaagagcaagcttcttcccaatgcagtgttttccctgcaaaggagaagaaatatatttcttgcctctctttccttagtcctgtgtgcttccccttgatttcaccaggacaattttataccaatcccttgtattttagaagagcctgatacatttgcaaggtctctctttatattcctgaattttgcatccctagacatcatcctttttgagagagaaaattccgagtgtcagttttcctttatcggaacctccttttatttgaactaaccacaatgggtcataatttataggcccagtcagcgcatcattgctcagatagagtcatttacctacaagtatccatcagttaggtgggggctgctagattttttaagtggaaaaaaatccaaacaggttcaggaagaagaagaaaaaatcatcctgggggcagaagaacaacaacaaaaaattttccttggggccttccaatttgagattgttgagtgttgccaagcaaaactaacacgcagtgggaaggttctgcttttctcacaaattctcggttaacacaaggcgtgccaacagctggtagagcgagagtcagggtgccaggctgaaatggagtggaaggcagccctggctggaagtcttgctgggaacctggagcgctgggaggtaaaactttacttggtgctggcagcgtcactatgccagtctgtttcttcccgagcttcaggccatgctgatgttcaagttgaataaatgagagctaatgattttttaaggcgtttttagtgaattgccgtgggaatgctaagttggcaagaataaaacctaggcgaggagagttgatttttgatgacccaaagaaggcatgtcctagagtggtttagtagagctcgaatagtctaagattgttccacatcaggaaaagtgtacagttatcagaattacttactaatgaaaaaaaggggaaaaaaagattattaggctgcagggtagtgggaaggaacagggtagcaactctacagtgacttggtctgagaaaccctgtaacttggatccagccagggaagtacttttcccaacaatcggttccgctgtcctgctgtgaccagtaacaggggaaaaaaataaaactcccctaaaggtaaatgattcacctcatgaacgaagggaagaataagagacctaagtttatatacacagattccaattgtaaaatcaaacctattttgttttctaaataaacaatatttgaaaatacaacattgcagtcttgttttcttttatactggctaggatggtctggtcctttagaggaggtcctgaataaaataatatgggctgtagagagaaacgccgtttgcttgataggtgtttttgtaaaggttttactggcctacagtgtcagtacattgcaaatttaagaatgttcactgacatttttagtagccacttaaaaaatttttctaagcaatgatgtcattgtattttacttataatcagaagtacatcagcccgtgaatttagttaaaggtttttaatgtcacttttattacatttttactgtgcattcatgtgcacacacacacttttaagcatttttgatttatatatccctctgcatattttgtgccttgtgatgtgtttaacgaatgacagtgtctttagtgcattgctacttggggtttctacactggaagtgtaatccgaggccttggaattggtcaaacaaaactcacttggcaacatttacttagagagcactctgcgagcactctgcgagcggacatgtcgatatcagctccctcctcgttcccccccccaccccccatcccatgtttatttgtaattaaagttaagatgcttgagaatggctttaccattaatctagaaacatagagttgtttcctggtgaatgatgtatgacagttttctttgtgcttcctctgaatagagagtagtttttgtggcattgttacagagaacagctttcctgtagggctcacaggctcaactgtttcaaactcctgttgttcggtaaatctgtcagaagggtctgcaagggaccgtatttatgaagagagtgtagagtggtcagtctaaaaagctccttagtgtagtactttgaattttaaattacacacataattcaaaggtaatgtaacttgccgtgtcggactttagtccattccgttaaatggagaaaaatgactgacgtgaagaatgacttattgattcttggtgggaaaatgacttctgtaatatgggaagtatggtaaaaggaatagcttaattatttagggagcacttttcaaaatgtgcttttacagcagtacaaattgtacgtatacaaatggtatgactaggttctttttttaaaaattctttcataggagaaagttatgagaaggcttatattatttcgttgctaaggcaaagtttaattttgcttaaattcctgtaagactaactaagaaaggtaggaggagtgatgagcagtttcttaaccctttaagaaatatgacttgttctaattgccttttcttatttacattatacttaggctggtgttaggatgccgtggctgccaagtttacacagtgcactttctctctctctttcttcttttggtttatgatgtttttcagtagtgtcatggaactcacttaatctgatttcatcaagtaaatatatgggaagttgagatgacatatttttatctgacatttgaagaaatattcataaaatagcagataaaatatttattttggccttttcattctgatctctcttttgactcgatgtgtattctttgcttaaggaccacagcctaatgttattttgactgcatttcacagtgttggcggcctttcagataaacagcatatttgtggttaattggctgaacatgttctataattataattatattaaaaccttaatgttcttgaacgtttgcccgcgaaggccactcacgtgaactaagttatgtttctgtcgttataactgagctggctggcggctgccattcagcaatccaggcaggactgggaacctgggaaaactgcagaggtttcttattatttcggtctgaaaccgctgtttggatagttttagaagttgaccatgaaaattgccttctggttgtaacttggatccccaggtttcaatctgtgggctaacgtttcttgggattttcagaaaggattggcttggctttttatcaaagttacacaacggctgtaaaaaataaataaaaaaaaagcaaaattagcactttatcaagtttggggcatatttccaaggccaccagggagcagggaaagtcaccaaaagaccgctccttgaaaccaggcaagaagccatctttgcagtgagctgagaggtctgatggccgccagctgagggagggaattccccttttgtgccttcgggattgatagagaagcccagtggacttagcatctgggaatcccagattgatcttttctggatattgggtcaaccataagatggtacctttccctgtgtaacaaagtcagattctgtgaaacacctgttttttgtatggcttatgagatgaggatgatttttaccttttttttttttttttttcccttgagacagtgtcattctattgtccaggctggagtgcagtggtgcaatctcagctcattaacctcaggtttttttacagaaaaagtttgccaccctctgatctacatgatgtccttcagtttctgtctctcaccagactgatggtgccatgagggcaggggcaactcctatcctaaggcgtggcccatagtaaggggtattggttagaagaatgaaagattgaatacgtcaaagtgatgagtacagagctgtctgtcattttcttatctttggcctaacaactgaacacattttatgaaatttgcaaatctgtttccaaacatgtttgaatggatttttatggtcttttaattaacccaataaaaatggtaacaacacagcaattttaagaaaataacagagccaagtattttttatagctatgcatgcaatccacattacacccacatgcagtatttctatggtccaaataagtatctgtcggacttagaatatttaaattaggatttagttgaaagattatgttctatatcttttttttttaaaaaaaaggaagaaaaataaagctcttcctaaatttatttacatgttggagcaattctggcactgctaaataaggcaggaaattccattaagtttaaatgtgctgcccttaccctaaagtgtttggagggcttcgtagaagagccaaatagattcacacagatcttatttgtagagctgaatgtgcacttcattaaaatactttgtaaggtattcaaggatgggctaggagggtgaggattccaaatcagaatcttcaagccagtgatccaggccaaaggtattctgccagagtgtgaggaaatttcacagcctcatggagacacctcccctccccacccttgttgaacagactctggaaaagtcaccatttcttgttggtcctttgctcttggagcattcttggcctgacctgtcaaccactttagcctccaaggtatctgagcctttctttcgcctctctacttagatcatattcttcctggattttggaatcaggctgggacacaagccacctcctcctccattctagctgtgtggctccaggcaagtggccacacctctttgagccactagttaactcagctgccaaacagggattatacatttacctcttggtgttgcaagaattaacaaggaggatatttgtaaatctccctgggagctggatggtgcttaataagcaggcattaagggttgattatctttgcactctctcctgccagattttgtaactgagtccaggcatctttagaaacagaaatggtccctgctcttctgtatcccctgggataacctagcatcatttcgctgggttacacatcctctcttctctcctgtatgtcgtccctctttcttacggtggttctaagctctatggatcacttgtcttctcctctgagcgggaactgggcaattggaggttctttcccctcccgtgctggtgggagaattgtttagtaggtcataaagtggaatctccatttcagtctgatccggtcaattctggtaggacttcatccaagcacaaagaaacctttgttttcattcaagacttccctaaaaggtggctgggtgcggtgcctcaggcctgtaatcccagcactttgagaggccgaggctggcagatcacgaggtcaggagttccagaccagactggccaacatggtgaaaccctgtctctactaaaaatacaaaaattagccaggtgtgttgtcacgtgactttaatcccagctgctcaggaggctgaggcaggagaattgcttgaaccctggtaggcagaggttgcagtgagccgatgtcatatcactgcactctagcctgggcgacagagtgagactctgtctcagaaaaaaaaaaaaaaaaaaaaaaaaaaaaaaaaggctttcctgaaaggtgattcacaggcctcttcggatcccttcgtgtttagcaatttggatttccacacagccttgctgtgccttctgcccatttgtcctctgctgctggtccctgggtgggacagctcccctttctccttgtctgggttgctcagatagagccataaggattctccctgcctcaagagctgacttccttccacgagttcctaaccacctgtccagttgattcttctctggacctgccttgacatctctgtgccaagcccagtgccggggttgcagatgcagaggcactggtgcatatttcttgagttgaagagcttgcaactgatgagccccttccactcagaaaaatgttgttcctggtcttgccactgcctggaacccaccaacacctcctctttccaatattgctggcttctacttgttctataagagccatgttctacaagttctgtattgtgtgtgagtccctctcaacaaaacaatttccctagtcatctcttatttatactccttgatgcagatttccattttactcttacctcattctatcataattatctatttgtgtgtgtatgtatgtccccactaggctgtgaggtctgtaaaaggatagtctaaatacagctatctattgcaaatcttataatgtgactccatgatgagatagttggatatagccttatgttcccagcaggaaggaagaaaggaaaggagggagggaggtaagggtgagagagagacaagaaaggaaaggaggaaggaaggatgggaaggagggaagaagagagtttggtcaacatttgttgattgtgaatgaacaaactaatgaacactaaatgaacaaatgaatgaatgaatggacaaatgaatgaatgtatgagtgggtcaagaacaagattcggccccaaggagatacgcgactttctactttgttttctatttggatttcacacaaaggctctaaggtctcctggtaggccatgctcagaagtctgggttgtcccctgcccaggacaggctcaccctggcctgtgtcctaggtattgtggggccgctgtaggaggatggtggttaaatcttggaggaaatccaggagtctcatgtccccttggcttctgtcagaaccagtacctctcatttattttgaggtcttggctgaagatgtatcatctacaaccctgcagatcagatgtgttagagcagagagagtggcgaggattaatctagactgaaatgtgctaatcaagctgtctcagatgccattttctggatagggaggaacagcagttggcgagtttaagagcaatatggaggaaccactggggattctatgcatgatcttaggggaagtagcattattatctccaacactggctgtttacattatcagaataagaatggttctccaaggccaggtgtggtggctcacgcctgtaatcctagcacttttggaggatgaggtgggtggatcacctgaagtcaggagttcaagaccagcctggccaacatggtgaaaccctgtctctactaaaatacaaaaattagccggacatgatggcaagtgcctgtaatctcagctactcaggaggctgagatgggagaatcgcttgaacccaggagatggtggttgcagtgagccaagatcgcaccactggactccggcctgggtggctgagaaagactcagtcttaaaaaacaaacaaacaaacaaacaaacaaacaaacaaaaacttgtctccaaatgagcagacaccagaatctcatggagggatttttcgaacacgtagcacagggcttcgcccccagcatttttattttcgaacttctggagtgcagcccaaagatctgcatttctagcaagttcccagatgatgttgatgatgatgcctgtttgggtatcacattagatgaagggctttgctaatttcagctgcagagtattgactcatggggtaggattcctgccatctgcagcttctttgggtcatcactagggtagaatcttattttctgagtatgaaaagcatcaaagttattttagtaaaatgcttttgctgtcattgctttaaaactagctcttcgaagtgggaaaaccaaaagttttattgaagcaatttgttgtaaatatgagttctgtatcacatttgggaaatttgtaaagccttactttgaatgtctttttcttcactctatctgtattgtttggtgctttctatataaatttataaattggatgtaccgccacagatgtcggttttctggtaataatacttttttacattaaaaaaaactcctgaaatgaaaatgtaacttagtcttattattgtaatctccccttgcctttttgcatggatcatttgtttgtgaactggttatttcaggaagggctcaaaggtaatttcatggtttatagcatttatattggcgccttcgatgagcaaaacatattgttttctaatacatgaaaccaggaattcatatatatatgtatatatattattattattattttcattttctaaaattacatgtagtacatgtatatcaacttcaagacattgagaacaaccatgtacagaaattatactctgtacacaggggaaatatgaaagttttgtaatgcaaaaaaataaaaaaaaatcaacatttgcaagcttatgagatgattttatttttaatgaatccaaatggtagcagggagctgctgttgtgtttgtgcattgtacagcaattcatatctaaaaataaagtaacatatggctttgttattatttagtttaggaattgatgcacctaaaggagttttgagagctctgggtctcgttcggttgttgtacatggcaaccaaataagagtagctggagcagagactttctcttcttcagattattaagatttgagcaattcattttttttggatggtgtttattaaagtcaagaaatcttttgcttatttgctaatgattctctcccctttctcttcttatatttttgaaggctgaattggtaaaattatctggcccaataaaaatatgtcctgggttggaaaagagcacaagtttctttttctagccctggagtgaggtggctctctggcctctgggttcgtttggtatcctggggagtcattgacacccacacactcctagtcacaagacctttccctcccatccagattgtgtttattttacggctctcgcacggagcatgcagctgtgtaaacctgagaatggtttctgcacagctttgatctttgcatggatcaacagttgcccttagtccctgaaccctgttccatggccccatatttcttggatttttccattttctagtaattatggcatcatgtagggagccttccaacagcatcccccacagctttgggtggagaatttggaaaaaatgccttaagtctgccatttgtagaaccatattaagtagtgatttccatttgatgccaaaaaaatatgccatttagtttcttcctaagaggcaatctgacaatttcgagtagactgctggagtctgacaaatttgaatgtattatggactgaataaatgtttattgaacaaatgccatttttttaactcttaaaatgttcagttcttccaccaaacatagatgacacaactgttggagacggagcaccggactgatgcagtgtagcattattttgtaatctacgaactgggagcctatggagacctatgcatggtggaatacaaaagtcatgacctgtctttatatcctagtatgggcaataaaaccctccctttaatagccttaaacatggtacaaggaaactgtgcaggagttccagggaaggtgccatttttccatatggagttgatatggtctgactgtgtgtccccacccaaatctcatcttgaattctaattgtaatccccatgtgctagggggagggacctcgtgggaggtgattgaatcatggagaccgttcccccgtgctgtgagtgagttctcatgagatctgatggttttgtgcggggcttttccccactttgctctgtacttctctgtttcttctccttcttgccaccaggtgaggaaggacatatttgcttctccttccatcatgaatgtaagttttctgaggcctctgcagccctgtagaactgtgaatcaattaaacctctttcctttataaaccacccagtcttgggtatttcttcttagcagcatgagaagggactaatacaggggtgatcacaaacagcctgcagactgggccatctttcttaggcaggatctcgagctaggagatgagaagagctctataggcaaaaagaatgacttggaaggccacatatggcagagtagctaagactttggggtttccagtttcagatagacatgggtttgtatcctggctctgcccctcaatgcctgtgtgatcctgggtagtttgcttaatccttatgagtcccggttttctcctgtaaattgggattaataatagtcacagctagctgggtgcagtggctcacacctgtaatccccgcagtttgggaggccgaggcgggcagatcacctgaggtcaggagttcgagaccagcctgaccaacatggagaaaccttgcctctactaaaaatataaaatttgccacgcttagtggcacatgcctgtaattccagctacttaggaggctgaggcaggagaatcgcttaaacctgggaggcggaggttgtggtgagccaagatcgcaccattgcactccagcctgggcaacaagagcgaaactctgtctcaaaaaaaaaaaaaaaaaattatgtccttctagattgtgaggattaagcaagaccatgcatttacattgtttaacactgtccctgagacatagtaaggcctcagtaactgttagctctcttattgctaccggacaagtgttcttattttcccttttcttcttcttccttttcctgttccttgcccttcctctttcgaagaaagtttacgccaaaaaggatgagctgggttgcagccagcattctggtttcacaggagcctaggagatacatggagaatattctgaggctaggttaaatagtttgtctccagtgtgggtgttagtcatattcttatcagtatctgaagaacccagaagactgactctcagaacggaaaactcttggctagaggattccgaaagctagcgtgaagtggaggctattactcagtgggtgccgtaacatgtctgtgtcacctggcacctttttattctctaatctcaggagtgagtgcttcctcctgccgtgcctggccacttctcaccttcagagtctttggtatgcataaattcttcatcacttcagtagagtgaaccctgattacctacatttattaatgaaaacaaccaagaatagttgagcccaaaagtacaaatcaatgtgctgaatcagtttatgatgtctccctaatttctgcacatctgttgagctgtgatttcaaattccattccatttcttttcttttcttttcttttttttttttttggagacagtgtcttgctctgtcacccagcctggagtgcagtggcgagattggcaagatcgtagctcactgcagcctccacttcctaagctcaagtgatcctcccacctcagcctcccaagtagctgggactacaaggttgtgccaccatgcccgcctaattttttgtatatttagtagagatggggttttgccatgttgcccaggctgttctcgaactcctgggctcaagtgttgtgccctgtttggcctcccaaagtgctgggattacaggtgtcagttaccgcactggcctggaaatcctatttcttgtcaagcaggacatcaaagttgagatctaagaatttggactaaaatttggggcaggttgtttccactactgtgtattgagagatggcagggaccatcttgccgagtccaagagattgtgaagtctaaaaggcttggccgcagtgttggttcatctgtaacagctgcctacaagggaatctttgagaaatacagattgctgcatcttataagaaggacagtgcttaaaacagaaagaattgagtagaaattaagacatagcttgatttttttccaacagaatcatgaagtctgttcaattttctttttaaaaagtaatttaatcttctagaagatatctacgtttattcaataatttcctaaggtagtcttcaaaacctaggagcctaggagatacatggagaatattctgaggctaggttaaatagtttgtctccaatatgggtgttagtcatattgtcatccgtatctgaagaacccagaagagtgaccctcggaaaggaaaattcttggctagaggattccgaaagctagcgtgaagtggaggccgttactcagtgggtgccataacatgtctgtgtcacctgccacctttttattctctaatctcaggagtgagtgattcctcctgccatgcctgtcctccctccctccctccttccctctcccctctcccttctcccctcttctctttcccctgtctccttctctccctcccttccctctcttcctttcgcatctgacatctccaaatagtttttcatgcaatggcattactaatggcttgactttttcgggaaatgattcattactttatgatttcaattcagtaaccattttcagctatgccataaatttaaatcctttaccatcaagataacgtttttttctcctgtcactgaaatattatgattggaaactatttttaaaagttgactctgtttgggacagctcttagggatttgtcctttataccagcatataacttgtaggttgtcagtgtctccaggggccatatgttcaccacctagactcaacagttgctaatgttttgccatgttttgtcagttcatctatctgtccatctctttgtccatccatccaactacccacttacccatccatccatacatttatccatccatctacccacccatccatccatccatccatccatgcatccatccatccatccatcatccatccatgcatgtaagttgcagacatcaacaaactttacccttaaggactttggctggcatctcctaaaactaaaggcattgctgtacgtaatcacaactatcatcattatcatgtctatgaaattggtaataatttgctaacataaaataatacctagtccataacaagatttactgaattattcacaaattgtcttttatagctttttgttttcaatcaggctgtaaagttcacacattacatttggtattgtatcttattagtctgtttattaaagagtttttttcagggatcagggttagagggaaggctcctttctggatactgtgtatactactaattttctttatcggctaccaaggttttctttatttttttcatacttttctttcattgaggaaacttattgttttgtacattttgttgtacctttatgaatctggttttgacttctggcccagctaagaagctggtttcctttggtgaaacatgggagaagagggaggaaaaatctgttaattagaattgtgggcgtgcactctgtttatctctaacagaataggcttcccacggctctgagctggaaaggaagattcaagtctcaggttaaaaaacaaaccctccaagacctcagggctgtttgcctgtgattagagtctaagaaagactgagaattggaaatcaggactgtctctggtcactgatggttcaactacagcacagatgcactgggtaacagacacaccgccaggcctcaggattacgttacctagggttaggactgagcctttcttccaccttcttggggttggagggcaggaatttaacatatcttagatcacagagtaaggcctcttctacccataagtttggtttatacatcaaagtaacattctaaaattagatgagggtgttttttttttttttctttttgagacagggtctcactctgttgcccaggctggagtgcgatggcacaatctcagctgattgtaacctccacctcccgggttcaagcgattctcctgcctcagcctctctagcagctgggactacaggcgcctgccaccatgcccggctaacttttgtatttttagtagagaaggggtatcgccatgttggccaggctggtctcgaactcctgacctcaggtgatctgcctgccttggcctcccaaagtgctggggttacagatgtgagccactgtgcccggccttagatgaggtttgtagatgtgtttttcatattcccaaagccatgaaatttgacaggtaaatatatcagttataaaagttttaggattaattatcaactaactcccagaagttgcctcagcctctctttttcagccttgtcttgccccagcccagagacaagccacagctataggttttatttctgaaggagaaaactcagtggaccattccactgcctcaggagatattgcctacctgcagacatgttttgtcttatccacacatgatgtaaaaacaaaataaaaatgctgagagaaatgccaattcagaggtttcatataaaaatatagctttcccattagacttgaaaattggaagaggaggtaacaattggccagtgctgagtagagggcatgtggtctctactttgccacaatctccaccataccttattgtctcccttctcagtcgaagcagctttacacactcctgctacttgccaagacactgtacacatttaagtttgctacctgttacttggcatatctcttggttcctaagagttttaggtattatgcaatttgccagctccctcagcccctttcctggctccaaacctttggctttggtttgatgttactgggttgctgcaggaaatttccctgtggacctcactactttatcaactgtaatggtcttgttgaagacaaggcttagaacatcatcagacccagagcctttctcagaggacctgggagaactctccatatggattttcatttgggaagatagatgctcttattggaacagctggttttccctttaaaacagggagtccagcagcttctaggatgcttagaatcagaattgttgctcactttttaaggtatagagtatttgtcttattcttaactacattttatatctttgcccttttttcccctactttaaataaaatctatctctaatttatgttacttaagcaatgacaaattctttttctgatagacaaagtaaagtataaataaataagacatccaagtaataatcagaagtattttttatgttggtctcattgtggtctttttaatcccaggcctgatgcgctttaggtaccagccttggttgaagaggagcttgaacagcctacacagacatgaaacttgagcaactgagctcatggacgttgcttttaatcaggatccagaactagggagttgagtgagcttggatttgagctccacttttcaaattttcaccacctgtgctctttcgtttttgttttttgtttttgtttgttggttggttttttgtttttttgagatggtgtttcgctctcgttgcccagtctggagtgcaatggcacaatctcggctcactgcaacctccacctcccggtttcaagcgattctcatgcctcagactcctgagtagctgggattacaggcatgcgccaccatgcccagctaattgtgtatttttagtagagacgggatttctgcatgttggtcaggctggcctcaaactcccgacctgagatgattcacttggccttggcctcccaaagtgctgggattacaggtgtgagccaccgtgcccggccagacccgtgctctttctcccaccactgccctgtgccaaccaccacccccactcctattctggaaagagccaagccgtcagctattgcttttgaatctatacgcaattctagcagcttcttttagagcccttttaaattagcatgaaatagttttactagccctgaggtttcagccaaggagctttaaaggagccagccctttgtttacttatttttcctcttctgaacatttggaaacatagcttcggtgctccttctccaagaaacctgagtcatgacctccccaaagtgtttccttcccgtggcctcttctcccgatcagctgtttgttatctgagggattcgttaataaccaggacatctgattctcatcattactcatcctctgctcactctcctttctaatgcataggcctttagccttttactttctacctttttgaatgctatacttttttgtaaaattttaattaggttaatgcattgacattgttcaacattcaaacgatggaaagggtgagtgtggaggtttggtttccccactttttccagccatgctgttgccttctgcagaggcttctagaattttcagatgaatgagaatcctttcagaaatagtctctgcaaactccagcacacccatagtgctagggtgggtcttagtaaaatgtctgcagggtaagcacactgttttgcactccacacaattcacttcacaatatttcatagagactttttcatattaatatataaagagatatatacgcgtgctgcttcacgataatccattgcagagctggtctgtaatttattcaagcattctttgttgatggatgttagggttgtatccattattttgctattatgaacaacaccataatgggcaaccttgtacacatttcctgtcaacatgtatcactgaatggaaaggatctattcctagaaaggatccattcctagaagaggaattctgtacaatatggccaactttctctctgttgaggttgaaccatttgacacatttcgctagcattgggaaaatccccattttcctcactatccatttttcttcctctctttccttcctcttttcccttcttcctctttttttttcttttctttccttccctttttccttttctttccttctttccttgccatttaaaacatactgataacttggcagcacagggcagtgattaaactcaggcactcaccccaccctacctgggaatctgaattctgtcttttctgctgctgtggattctcagtccccaagttgtgtaaatcaaagcttctcctgccacactagtgtgtattaggccaggacttcatagtgtgattcaaatcaccaactgaatttttttttcctttccttcccctttctgggggactacgtttttcatggagaccggggccctccagctgctgtgatgatcctcccttgccagggaggtgctgttaatagcaaatgccaagtgagctggtgttctgtccctccggcctccttgctcacaatagccaggaggaaaaagccatgtaacctctggatgagtcccttggccatttagaagtgaaatgaacatccaagaagaagcatagacaatgtggaggaagaactcttccaaatgatggcagggatatttggaatctttccccctgagttccctctggaagttaaagcccagatcccgtgaactgattaaaaagccccagaccattcccgttccagtcatcttgaaactgagcaagaccgtgtcatccatggagcttgaacataggagcactttaaaaaaaaaaagaatgaaaagcccctttcttgttttggtaatgatttaatgacagaaagtcacccacccaccacttgggtaccacgcagcccacattaaacaattagcccttgacagtggatagttcaagttagtttgaaatgagaaattgccggtgacctgaaacccatcattattaaccttgtggcacaacattgccataaccagtagccaactctcattttttctttttcttttttttggttggaagaaaggctcattgaggaaagttggctcagttcttttttgagtgaagtggtcagaccaccaagaattactttcctttgattgggaacaggttctaatacagatgtcctttacatgggcaatccacttttctcattgattccacaatcaattcgagctgtgtttatatatagacacctgcccacagagaccatgtggagaagcatttgcgtctcgctgcctgtcttccaaaggatttgccttctagtaattcatgtttttatagcttaactacatttatagtgaacgggtggcttcttcatccaaagaaagaacaaatgacaaaaagaaaaattttgatgatttgggaaccgcatttatggaataataacattcatgatacctctggataatgacaataattacagtatacgattctagaagggtgagtctagctgttcccagtgtgtttccatgggttgttatgtgttactggtcaggcgatcagggatttgctgaagattttctttcccatgtggcagtagatatttcagaaccctgcatcatggtgtccacagaagtccccagagttgtatgagagttcatctgggcacctttcccaaaggcaggccccctgtgcagcttcaactattcactctatttataatgttgttcctggatattgggcttgcttccacttgtggccaggagaggatatttcttactccagatcaaagagttgagacattgccttcccacaattcccagtgagcccaactccttaccacaattcccaccccatgccttccccaaattcctgatgagccctatgccttcccacaattccctgtgaattttgctccttcccacaaccccagtgagccccactctgtcccataattccctgtaaatctcactccttcccacaatccccactgagtcccattccttcccacaattccctgtaaatctcactccttcccacaatccccactgagccccactccttcccacaattcccagtgaaccccacttgtgtagtgtgtctgtgagtagtctgcccactctccttatgacaggtttccagtattatctgtttcataacccatttccaaccttctgggttttttccttcaacgtttcctgtgacagttctccattatatctttgttagataatagttagcaacccattaataacttccaactttttgagcctctaccatatcttgttttcactgggatttctacaccgtggctactttgtgggacctgacttatcaagaacttaagcagcatctgttagaaaaggtattttttttatgaagtaagtagggaactaactacctgttcactgctgcccgttcattgctagcacaatgccaagtgtcaaataaatgtttcttgaacaagtgaatagagtacgcttctaggcttctggaaacggtgaatgttgctttatgtggcaaaaagggactttggagatgtgatcaagttcaggatcttgaaatggggagatgaacctgaattaccgaagtgggccctaagtacaattataagtgttcttatgagagggaggcagaggggactgtgactacgaaagaggaggaaacagggagaagaggtgaagcaggtgtgaggcaacaatctggtggcttctagcccctgaaagaggtgagaaatggattatcatttggaggattcagaaggaaccagctgtgctgacaccttgatttttttaacccagtgaggttgattttgggcttttgacgtccagaatgataagagaataaatgtgttgttttaagacctaagatcatggttatttgttagagcagtgatcagaaactcatacaagtatgaatgctaagagtaaaggcacctgcctcccacatactggacccttaatattccttttcatgggaggttttgcagattgctgccctccttgctctccttactcttctccttttactgaaaagatatttactagatgtctagcatgttaaagactgtaccttaaaaaaaaatcacactctaatttagcacagtttcaattgtggttaagcaccatgccattcacacttcagaaccaagctcagatccatgtgtgacactctggaatgtggcagctgatggaggaagggggctgaagttgaatctgcagtagttgagttaaccttcccatggtgcctgcactagcagggactggactgagaccccagctttcccagtcaggccttcatttttctctcatggtgagagctttggaaataggcagtgcagtgtgggagtccttcccctagcatgttagtggccagcaccatgccacacagccacccagagctgcaagagagtctgcagaggtgattgccccttgctaggtgagtgtaaaccaaaaataaattctaagctccccaagcaactgaatggatccctgcctctgggccaaggggattccgaaataaacctgaaaaactagttcaggcagtgatgggaagagggggttggatatgactcattatacccttctttttttggaattcagtcacaactgaacagcattagcattaaaacagatcctaaggctgacaaaacagactctttatagcaataagataccaaatttcaaccctactctagtataggatcactttgcagatagcaggcatggaaagaaatcaaattattttaccccaaaatatatttctctggtatatttcgaaatggccctgcaaagctgtttcttgtctacattctgtagagaacatccttccctttccaggtcttttcctgatccaggagagattcactaggagtctggcacctttttagttttgataagagatatttaccatttattctctctgaggcctatttcctggaggcttcatctgcatcataagaaccttggtctttttgtggacttatcttaacccagatagtcctttctactgatgccaggtgtttagctaataacacttttaaccaattgccaatcagaagatccttgaatctacctgatacggtttggccgcatcgccacccaaaatcagacagtcctatctgttgatctcgggtgtttagctaataactcctttaaccaatttccaatcacagaatgcttgaatccatgtgatatggtttggctacatccccacccaaaatcagtcctttctattgatctcaggtgtttagttaataactcttgtaaccaattaccaatctgaaaatccttgaatccacctgatatggtttggctgcatccccaccccaaatctcatcttgaattgtaatccccacaatcccgacatgtcaagggagagaccaggtggatgtaattgaatcatatactcccgatagtgagttctcacgtgatccgatggttataaataagtgtttggtagtttctctgcgttcattctgcttcctgccgctttgtgaacctggtgctttgcttccactctgccctgattataagtttcttgaggcctccccagccatgctgaactgtgagtaaattaaacatcttgcctttataaattacccagtttcaggcagttcttggtagcaatgtgagaatgggctaatataccacgtatgacttggaagccctcatccccatcactttgagttgtccttcctttatggaccaaaccaatgtactccttacatatattgatagaagtgtgcctgtaacttttttcccctaaagtgtataaaatcaaggtgtaacccagccaccttgggcacacgttcccaggaccccttgagactgtcttaggctttgttcactcttgtttgggtcgggaataaacttctttaaatattttagagtttcactctttcaatcaacgtacgtgactacccagaattaaactggaatgctgttaataagagaaatgaaaggatgatgggagatgtgcacccagcagtgtctgtcttgtggtcctgaagtctaactctaatcctggctccactacctggaccatgacaggttgtttaattgttctagttagagtgttctcctatgtaaatagggataataattggatgtatggcaggatttgggggaggattaaattaggttatatgcgtgaagttcgtagagccagggtctgggcattaatacgcatttagttactgtcgctcctgtgatctgcacaattattgtcattatcttcccttcctcctccttccccctccttccccctctctttttccttttctttctatcatcatccatagctctcttgccccattgttttaaacccatctgtttttgttgctggtaactgtatccaaaagtaatacagaattttccgtaagaacatttattgtgtttccttctacccacgaattttcttatgctacacacacaacccactgaaatttcacctctattgtatgtggcttttctagaaacgtgtgcttctgggctttgtctcacacctcctggccagtgtttggcatgtgctcacacatgcacgcacacacagcctgcactatgtttgttgactgaatgaattaatatttcacagaataacaaacacatgctgattatactccttgggaagctaatttgttttcagctctgagagcaaggccaaatcaccagattgatgcctttggctgtgtatctaaaggacgtgccattgcagctaagtggacctgaatgtacagtaagacttagtggtcaccagaatgcatgccaccccggtgcttctgcatgcaaagggtgcgggccatgtgccagtcacagtggaaaaggcatgcttcgtgtcagcacatttggcatctctctgggatcggggatttataccccaaaaccttgctctagagatttggcttccattagcaagggtaaggcttgtaagaaaggagttttactcacctttgcttgctctcacagctgtgtcagcccattttcatctcttttcaatgttttaagccctgagagaacccagttcaattcccagcaagaaatgagcctctgtaacgcagccccagacccaccttcgagggtaggggcacccttgttgtcacgatgtacaggagccaggcttggcatcggagtggatgcttgggaagccccagagaaatagacgagtgagtgcaagagccagctgcctgcgtggcttagaggaagatttcaaacacctagtgcactgaaagtctgacttaatttgtgatttgtgaatagtctcccagaagctatggggtacagatgtgggacttgtgaaaaataccagacatcctgtgggttaaagaaaaagaaaggggggcggtgggtgaagtgtgagcaatttctggcagctttgtgggcatttattatgtctaggtggcacagtgtggttggactggttggtttcctatcagttgcattccctgtatgtcttcagccaatttttttggtaatccaaggcctgatgtatataaacaaattcctttcttgatcatctaagcaatgaacacttaacagagtcaagcttggagaattcagttcctaccacaaggtccggaatggaggatttataactgggagacagaaggtatgctgaaaggtactcaaactgtcacttccttcacccccaggagcactgaagcagacactgattcctctgcagttgttgggcttttgagctacttccctcctggggagatgcgtgttaactgtttaatgactggcaatgccgtaacagtgagcaagcaatgtgaccttacaaatacatgtgcagaaatgcagatgagtgggcctaaagaatccagactcaacttacttctagtggtaatggctgtaggagagatggggagtaggagaagaaaagccaaaggcagactttagtctggtttataatgctttaatatttttttgaaggaagaaaaatgttcattacttaacgtaataattatttttaaaaagcagcctggcgggggggtattcatttttctgtggctgccataacaaagttcttcaaacttagtgtcttgagacaagacatttattttcttaaagttctggaggtcagaggtctgacacaggcctccctgggctaaaatccaggtgtcttcagagctgtgttcttttggatactgtagaggagaatacatttcctggccttttccacgttacagagactgcccatgttcctcgatccatggctccttttcggtcaccttccagccagcaacattgggctgactccttcaatggccatgtctctggttctttgtcttttgcctcctcctcttacttttaaggacccttgtgatttcattggtctcagctggatagctatcaagggtcactttaaggtcagctgactagcaaacctaattctatctgcaaccttaattcatataacctggcgtagtctcgattttattttaattttttaattgaattcagctttacagtatcttttgtagggggtaattttagcttctttctccgttgaaaacttcaagtaaggaaacacttatattgctagtgagtggccagctggagttgtaggtctaattctttttttttttttaagacggagttgtgctcttgtcacctaggctggagtgcaatggcatgatttctgctcactgcaacctccacctcctgtgttcaagcagttctgcctcagcctcctgagtagctgggattacaggtgcctgccaccatgcccagctaacttttgaatttttagtagagatggggtttcaccacgttggctaggctggtgtcgaactcctgacctgaggtgatccacctaccttggcctcccaaagtgctgagattacaggcatgagccactgtgcctggctggttgtaggcctaattctagcaatctcagcaactgtaggatttctctgcattggaggaagcaagactgaaggtcgtctggctttatggacaatgtgcttagaagttcatgccataccttaggtccagtcttgtgactgaaccaaccagacaggcctaggctctgccctaagtggtcagcctccgaggtggtagcacgcagggcctcacttcccactgcctctgtctatgggcatgtgctgtgtgccattctctccccttatcagtgggttcccagctgcctggtgtacaggagggttaagtagatacctgttgagtgattgtgaatgttttcattcacgggggcagatttgtgtcctactaacaccagacatgtcctgttttcagattacttctttttcaacatctgagtacctataacatctaaagaataacaggaaaatccacctgggtggccaaagtcaatgtaatgggcagaaagggcatgtggtagacttggaaatcagacatcttagactccaacacagggctcttccacttgctagccatggaacctcagactgggatccttgacttccttatctataaaatatggcttataactcaccctgtattatagatctgctgggaacatgatagaacgtctgaacagtgctggcttatagcaagtgttcagagatgtgtttcgttgtttttcttttttctttttttgagatggagtttcactcttgttgcccaggctggagtacagtggtacgatcttagctcaccacaagctctgcctcccgtttaaagcaattctcctgccttggcccctggagtagctgagattacaggcatgtgccaccacacccagctaatttttgtgtttttagtagagacggggtttctccatgttggtcaggctggcctcaaactcctgacctcaggtgatctgcctgccttggcctcccaaggtgttgggattacgggcatgagccactgcgtcaggcctattgtttttcctacgtaccgtgattgcttgctttcttctctgtcgatgtccctgccatctaaatgctgagtccccttgtctacattttgaggctcttctattatggaagagggctagagaggccatcagaatttggtttcactagcctttgatccttcctgtttaaggagctcagcatttagcttcacttccctgtcattcatcagaattcattctcagattggaattgtccagtcttagagtgatttttgtccccagtgacacttcccttatatccgtgctgacacaggttcaggagaccaggtcgagtcgaaatcctggctgttccgctttctaacaagctgcttcatctttctgtgcctcacacatctataaaatggagctgggcatctgtctccttcagttatggtgagaattaaaataaaaaacacaaagcacttctaagaaagtacaggagaggccgggcacgatggctgacgcctggaatcccagcactttgggaggcagaggctggcagatcacgaggtcaggagatggagaccatcctggctaacacagtgaaaccccgtctctactaaaaatacaaaaaaaattagccaggcatggtggtgggcctgtagtctcagctactcgggaggctgaggcaggagaatggtgtgaacccaggacgcagaggttgcagtgagccgagatcgagccactgcactccagcctgagcaacagagtgagactctgtctcaaaaaaaaaaaaaaaaaagtacaggacatacgtaggacccctgaacatttatccccctgctgccagtacgttacagcaaccaccaagtccacctctatcaggatggtgccaatttgtggggtttttttttttttttgagtcggagttttgctcttgtcgcccaggctggagtgtaatggcgtgatactggctcactgcaacctctacctcctgggttcaagcgattcttctgcctcagccccctgagtagctgggactacaggcacaccccaccctgcaggggttttttttttttgttttttttttttttttttttctgtattttcagtagagacagggtttcttcatgttggcctggttggtctcaatgtcctgaccttaggcaagccacccgccttggcctcccaaagtgctgggattacaggcatgagccatcacgcctggtgaatggtgtcattttgatgtactgagccatctcagtttttccagcaaccttccctcacctttgtggtcagctagaaggtcagttaacacatgggatgggaattcttgccaatgtccttcgtaaaagaagaacttctccttcactcacatgtcctgatacttcctcagcatttcattctagcctttctgtctccatccaccatctatcaatcatctatcatctagctatctatcgatttctcttttttggctttaattttgtcactttttcttctgtctgctatagaaatagcaaattttcttatgtaagaaaactctgaacgcgaggccaaagtagaattttccctgaaacagctaccttttccttgaaattgttctatatctaaaatcactaggtgaggagtaatagaaatgtagacatgagaagtgaaactgttttttttccttgtaaaagcttcattgtgccctttagaggataactctgtagtttgatatgataaaaataattatatgattatgctgagtgaggtggctcaagcctgtaatcccagcacttggggaggccaaggccggcggatcacttgaggttaggagttcgagaccagcccggccaacatggtgagacccccatctctgctacagatataaaaattggctgggcatggtggggtgcagctgtaatcccagctgctcaggaggctgaggcaggcgaatcgcttgaacccgggaagcagaggttgtagtgagctgagatcatgccactgtactccagcctgggtgacagagcaagactgtctcaaaaaagaataaaaatgaataaaaattatgtgattagagaggggaaaacaatcatttcttgtgcgctaatgccactcagcaggtgcttacactgtctggttcatccttacaatgactccatgttatcgccattttcagatgggtaactcaggtagaaatatgattccattagtttaaaaaaaaatacatagaagataagaaaaatcaccaaaaattcccagccacagtagatgtatctgtatttaactactctcctcgtgttgaatatttatcaggtttctcgttttcttttgtttttgttgtaagtggcactgcaggccagttgcggtcactcaaacctgtaatcccagcactttgggaggctgaggtgggcggatcacttgaggtcaggagtttaagattagcctggcccacatggtgaaaccctgtctctactgaaaataaaaaaaaaatcaggcatgttagcatgcacctgtggtcccagctacttgggaggctgggtcaggagaatcgccttgaacctgggaggtggaggttgcattcagtcgagaccatgctagtgtactccagtctgggcaacagagccacatctccaaaaaggtggcactgcagcaaacagcatccacatgtgtgcacagaatattgttctgttgtgtacctcagatggctttgttaggttagattccctgaagtggaatggccagggaatttaaaaagggttttgctcttgtcacctgggctggggtgcaatggcgtgatcttggctcactgcaacctccgacccccctgggttcaagcgattctcctgcctcaggctcctgagtagctgggattacaggtgcctgccactatgcctgggtaattttggtatttttaatagagatgtggttttgcggtgttggccaggctgttctaaaactcctggcctcaggtgttctgcccgtctcggcctcccaaagtgctgggattataggcctgagccacggtgcctggccaagtctgttttttaaatctggaaaatgggacttgttaacttctgtattgtcttttctgctgctttatccaactttgcaatctataagcttctgttactggaaaatggtgatggtaaagtaattgctttcttatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttattgaacatctaataagacctggacatttggctgaatgctggaagtgcaaagatgaaggaaagttgctttttggaaggatattagaatccaaaggtgaagcctgcacagtaagtaggccagtggtgggataagggatccattggcccaggaaattggagggacttggagaaggaccatctcacccgtccaaagaatggaggagtaagggaaggcttctggaaagaagttgtgttgaggctgtgtttggaaaggtgaataggagttaggccagtgaggaatggggtgaacaactgcaggaacttgagtgatactttggggtgaattctctctctctctctgtctgtctctctctgtctctgtttctgtctctctcactcacattttaggtaaagcagtgtttcttccccaggggtgattgtgtttgttacagtgtgatggagactggatactgcatctagcagatagatgctgtcaatcatcctacaatgtgcaggaccgtgcccacacaaagaatgacccgtccccaaatgtcaacagtattcaggctgagaaaccatgtactaaggcacaggacaagcatcgggttggataatggcagagaaaagtaccttacctccttccagaacctgagagtgtgtgactgtgagtgtgtgtgtgtgtgcacacacttgcgtaaagtgagaaaaatctggtgttttttcgaagtctgcctcgtttaggctctggactcctgctctctgttgactctgtccagagagtaagcgactcagcaggtgtgcctccccatgggcccccttcacggtgtcctcaccttgatttattagagcattttattcccccaacagtgtttatgacatccaaggacttggtggaaccatgaggaaatgagagtggacagtgagactactatcattcattttcactccccgtaaacatcttctgtttctgttttagaagacattgctaatcccctcatgcactggctttgcgaatttctttttcagcctgggtttgaaagcaaagtggtagtgactttttcctgatagctgctgaaaaggttccacagtatttggaccgctgcctgcttctaccctggagcacaaaagatccaggcgtagaaattggttctaacaatatccttttagagaacaccaaggggatgtgagtcactttccctttgatttaaaggcactgcgtccctcaaattcagagttagagggtgacatgtagttgatctttacttcccgggggcagaggaccataattaaatggctgtggaaacccagaagcagcctacagaaactcttaggagccctccgtctgggaggaatttttttttttttttttggtatatctgtgtttacagttctagaaaagtgttggttttgagggcaatggagacaggaatgaggagaaaatgtataaaggagaggttgctgtgagccgagattgcgtcactgcacttcagcctgggcgacaagagcgcaattctgtcaaaaataatattattctgttgtttcctaattgttgatttgtggtccatatatttggttccttaactaaattggagttcttaaaacaaatgttaagaacacaacatttaggcacacagtacttggattccagtagctttggataaattaataaaatccttccattttctcagttgtagaatgggaatagtacccaccttataggcttgctgtggggagtaagtgggataataaatgttaagtgcttttagctgtactgtacatacataatttctgtaagtactggctattttaaaaattattttaacactattctgatataggaagttaaaaaatagcacagaggggatccctgtgatttttactcacttttctacaagcatgactccttatataactacagtacaggatccaaaccaggaaacatgcctgggtacaatgtgagtgtataattccaggtaggtaaaataatggcccttattaggatgtctgcgtcctaatccgcggaaactatggatatgctttgttacatggaagaggaaaattaagattgcagatgaaattcaagttactgatcctgcgaagttaaaatcaggagattacccagggttatctggttgggcacagtgtaattgccaggattcctaaaagggggagagagagtcggatgagtcaggcagtgagatggcagcatgagaaggacaccgccacacattgctggctttgaaaatggagggaggcgggcatgagccacagaaagtaggcagcctctagaaggtggaaaaggcaatgagatggattctaccgtagagctaccagaagggaacacaccttgctgatgtcgttttactattttcttatttatttttgagacagggttttgctctcgcccaagctggagtgcagtggcgctatcatggctcactgcgatcctcccacctcaacctcctaagtagctgggactacagtgtgtaccatcacgcccggctaacttttttgtatttttagtagaggtggggtttcatcatgttgcccaggctggtctcaaacccctgggctcaagcggtcctccctccttggcctcccaatctgctgagattacaggaccctgctgatgtcttaatcttagccccttcagatcccagttggtcttctgactccagagctataaaagaataaatgtgtgttatttcaagccgtgaatttcttattaatgtgtcacatagcaatggaaaaataaacgttctatgccatttttatcacatgcgtaggttcatttaaccaccgccactactaaaatacaggactgttccatctgcaccgaggtctctctgtgctaccccttgaagtcacacttgccaccctccgcccttagcctttctttcagcctgtgaggaagcaaaacttttactcttcaggcatcacctcacgcgtcttttctgcctgggaggcactttttccagttttcctggcgaaatagtcatcttttaagttctctgacaacccctctctgagcatctaatcccaatcagaattccctcctaatgtaaactctcattatatcttttaactttatttcttagcacttatcatgctgtatggataatggtatatttgggtgagagtatttgtttctctttctccctaagtaggctggaaactgcatgagggcaaaaacttagctttactcaatgttttctcagcttcatgtacgtgactgtatacagagtctgagccgagaaaaccttccttgcatgtacgagcaaatgagagtattcaaggtacagaactgaaattttctctgggtttttaagtggaagagtacacaagcattataagcaattttacctgcatttactcaacagacttttgttttttatccccttcggtgtaggttgtcatactaaattggttcagattctgtatctgggggtagttagacttctgtgaactccaagtagacggttgaacatgactgaacttgcacagtggacacattgtgcatttgtttttaagtccctagctgtttccagaaatagtttggttaattcatactgataaaataaatccccgtaagagcattattccccaaagtgggcttcctttgccaaacctaattatctggagaaggtattgaagaagtcaacttacctcttggccaaatgctttctagaattattcaaccaaagacagcaggctgcacctaggggaagccaaacatctggatgaagaatgaaatatccagatgttttcaagtatctggatgtttctaaccatctgtttctcttggttattgacaaatgatccagctgttttgcagaagatggtataccttgcctaacagaagagagaagtaacattcttagaaaactttgacatcatctcatctgtactaacacaggatttctgtctttaattgaagccatgacttgatcacaaaaatgaaaatagcttcatgtgtttctgaagctgttgtcttgctttgggcgccagactgcacaggattttaggttaattgtcttgtttacaattagagtctgcattgtttgtagcttgattctatttataatgtactcacaccttaaccaatagcctcacagatggcatatgagaatactcatactcagtgctgctaaaaacagcctgctgcctgaacaccagagtgtcttttaaagcgtagaaaagttgggtacataaaatttctgttgcaaaaaggaatgtataggccttaattgaaaatgtatctttctggaacaggagttttagaagctgagtaccacccactcccttgctccacaattctcttttgtttaaggcaacacgtaggttcttagttttttaaatatatatatatacgtatatatatacgtatatatatgcgtatatatatacgtatatatgcgtatatatatacgtatatatgcgtatatatatacgtatatatgcgtatatatatacgtatatatacgtatatatatatgtgtgtatatatatatataaaaatatatttaaataatgttaaggctagagtagaatgacatcatgggaaggcttattgaaacttggagtggattcgtagtctgccacgagaatccttgtctgatgtttgtgggtgtgtaggactgaatttgaagtccttaaatggatgtcctaacagtgaataaagacgtggggcttgaatttatgtattatcttattactctgtcattttcttgagtggtacaccagagtgcatggaaaagtaaatgattggaagccgcgtggtagttaagggtgatgatgtaggagtgagaacacaggcttggtgcctggcgtcagcacacacatcacaggccctccctgtcagtggctgtcgtctgttagtgtttccagcacagctctaaagagcgacgcttggaggctggggagagggggatggagaggcatatgattctgttgacatttagtgacatgcgctcttcccaaccaaacagatgcaaatggattttagttgtgagtggttgtttaacacctgcataagtgacagacctgcagagacaggttgtggatggaacgcaaattcaaatcagtgcatgagaacagcagctaaagtggacagacccaaatgttttgcctaaatatttggctcctagttgtacaaaaagccaaatggtttcaatttcatcctatataaaccagatgattgtgtatttacttctcacttgccctgccagggggatggttggtggggggaagacaaggacaaacaattcgaaagagcaaatgagccaaaatccatctggattttgttaatgctgattatatagtttcttctgttgtttttaatgtcttccaagccttctgtgtattagccagcattaaggggaaaaaatgacattttgactttgactccctttgtaatgtaatgcattgttatgtatttctgaagtttttcttaaggaaatagtatatgataataatgactagcactcactgagtgttcgtgatcgccaggatcaggccaaaggttttcacgcttgtgcctttttaaacttctcaacaacccagtgagatagatgttattagcccaatttaaggatggggaaagtggggattcacagatgaagtaacttgcccctagcatcgtacagtcagtgagtgtgagaggtacaattcaaacccaggtagacctgaattaaatcttctgaagcaactcttcatcaccaggtgtggctacctccaatgattactttgtttttatgattatcaacaaagttactctgtggagcaggggcaggcaaacattttctgtaagggagagacagtattttatgctttgcagtacagtcttttgcaactgttccactttgtcaccacagcacaggagcagccatggacgctacgtaagaaaatgagtatgggagtgtttcaattaaaattatgtatggacatggaaacttgaactttttatgattttcatgatcacaacttactctgatctctttcaaccatttaaaaatatgaaaaccattcttagtttacaagccctacaaacactggcattgggttaggtttggatgatgggccattgcactccagcctgggtgacagaatgagactctgtctcaaaaagaagaaaataaaacaggcgttccttacctacagcctgctatgatttggggttcttgtatttttttttgtttgtttgtttgagacggagtcttgctctgttgcccaggctggagtacagtggcacgatctcagctcactacatctctgcctcccgggttcacgccattctcctgcctcagcctcctgagtaggtgggactacaggcccccgccaccatgcccggctaatttttttatttttagtagaaacggggtttcaccatgttagccaggatggtctcgatctcctgacctcatgatctgtcagcctcagcctcctaaagtgctgggattacaggcgtgagccactgcgcccggccggggatcttgtattaatagtagggagacagtaagcaagcaaggctcagttaatgataaattgttatcaggagacccagcagtttctgctttttctaccctcctctttgagctctatttaaactaataggttactgggtttgaacatgccatgcagtgggaagaggcgggaaccccactgagctgtcctctaagtgaatcatgcccactatttggttgtgaggctgtggactttacttttcacgcatggcattgaaagaacagggaagggtggattccccatctcctcttcctctttggaatcaggaaaacatgtttctattctaaatgttctttgataaataagattgcatgttcctggctcctgtaacatatattttctttttcctttgtccggcatacttgactaattgtagagctttttgagcctaaaactggataggaacccagtgcatgcactcttaaggactcagaggcctgctcaaggttaagtgcagtatggtctgaataataagcatagatgcccctttactgagcagcagctgggtgctgggcactgtgctaggcatttttggatgcattttcctcctccaacttcactttcccctatgagattatttcctctgtgttagagacaagaaaaatcaatttacaggtagtttaagtgacttgttcaaggctacagtaagcttgaagtggcaaggatgggatttgaacgtctgtctgcttgattccaagaccgtggcctttgtcattcaggtcatgctgctttcctcaaggcaaggaactgaggttttctgttggcagtgaggtggtggcttcttgtttccctggtcttagatactgctcaactcacagttgaaatgtagaagtgaaaagtcagacagcagcaggtgttgctgggaatgtggagaagttggaaccctcacacaccattggtggggatgtaaaatggtacagctaacttggaaaacagtcggcggttcctccaatagtcaagagttcccatatgacctagcaattccactcctaggtacgtatcaaagagaaatgaaaacatggaccaagacttgtacatgaatgttaatagctgcattgttcttaatagccaataggtggaaaaaaccctaatgtccatcaatggacaaatggataaatatgttgtggtaaatgcgtgtaatggaatattccattttatattcataaaaatggacaaagtcctgaggcattctataatgtgagtgaacctggtaaacatgaggctaagtgaaagaagttagttacaaaagtccacatatggtgagattccgttctgtgatatgtccagaacagagaaatttagagatagaaaatagatgagtgatgactcagggctgggggagttgggggtgggcgggataggaggggtagaggtgaaggtgatgaaaatgttttgcaattgtctgtgttggttgcacaactctaaatgtactaaaaatcattgaattatacaattttaaatgggtgaatcgtatggtatgtcaattatatctcaataaagctgttaaaaaatctgaaagtgtcaattaatctttgctcccagagaaaaccactcagggcccgagctgctcatgggcacaaaaacccattcctcagattccttggccatgctggaagcctggcttgtgtgagagcctcaagtctctgtaacagcctgggagtgttggtcccgtcacagggctgtggcagcctttaaagctagaaggcactgctcagaggaactggttcctttgaatccttttccgtcaccatgcaaatgtttacaagctctaatcaggagaaatgaaaaatcacatgtctaattttaaatatgttgcctctgatcacaggtgttgttaaaacagctcttttatgactttataaatactcagatttattttgaagcaatgtttcattattcctatactatgattaaatattgagactattgcttttccaattgttctattgcagtatttaatgagtgcaattaaatggaaaaattgcctttttaactggtgatagtccattagtgtctctgtctcttcaggaaagaaaagaagtgaattattagaatgacaaatgaggcaaagttaccaccgtgatggagaggtgcgatttccctccacataatcttcagttagtgatctctgtaagagaatgtttttcaaaaggctaatagagaagtaatgagatcagaaggaggtcaacccggccttctccgtttggcagcttgattaatttatttctccttcttggagattgctgcaaggggcttttgtcaccctgtgtttttcatgggactgtaacctgagtgactgctgatatattagccttgcaggcaaggaagcaagtccgttgccctggaatggaaggcataggagttaagggtttgtttgcttttgcaacttgaacacactcattgggagctttggataatgacaacaatgatgatgattttaagagttaatcaaattaaaggctatgaaatgatgcccactgtggatcctgtgcctggtgctcagcacatacaacatcatttcattttcacagcccttgtgacatgatagggctcttttgcagatgaggaaatgcaggctcagagttatctagcattgtacccttaagcagaagggggaggtaggagtgaatctctgtctgcctctaaactcttgagctcccctccagaagtccagggctcttagaaactttgtactcaaccattaaattgttgccattgtgctgaggagcaaggaaactgggatcacacagctagatcacagtgggggaacctgaattatggggatgctcacaaaagggcaaaacacaacggttgctgtcatttgatgctttatgttaagtgtgcatatgctcagttgcagaaacctaaattgctaaattgcaaggctgtatatgatatgccaatttggcatattctgtctttttatattctgccacccctatcatacttaggaaaatgccaggttgtaatcattcactgggagaaacaaggggttgaacgttgttatcgcgcaaaggaagctgggcctagtaaaggaatgtaaatactaaaatgccagcatcactgttacttactgtgtttctctggatgtattacttaacctctctggctttatttctgcctgccctccccccgccccccccccccgcaatgcctcaatctgtggcagagttgttacattattgaaaaagaacataaagcatattttctggcatacagcatatgtttaatttataatttttgtttttatcattaaaagcaacagattgctgtattcttgcctgccactgacatggacttaattgtttcatttagacatttaagtgggcaatacacttaaaatgcagatataactttaattgtcaaaacatgcttattttaggaaatgtgtttctccagtaaagctcagtatctggggctttttcggttgtattctatatgaatcttgaatactgaagtttctcaccatggagatgacaaacacataaaatgtttactttgcaaactgaatttctcttgctgctttttctgaagttccccagaggctcatcatcatcaataccatcaattaatagtcatccttggcttcctcgatcctcagcactgcgctgggcactgccccccaggagcatccatgcacctcaaatcctgaccttgtgactttcaagtccctaagtgaccccacactgaagaatctggtgaaggccatccaagcccagagttcatttaagtggcagcgatgggaccaaattataggccaggtctgtcttatgaaagatgataaatggatgtgtcatatcgggaaagaaatcactctgtcatcatatgacaggctggcttgatttctttgcaccagtgtccctaaaagttgggatgggggtgtgaagcgtgccagctttcaaagccagttgtcactccattttgtgctgtacctccccagttatgaatctggggcatcttcactggactctccaagccccagtaccctcagtgtggaaggagaaagcatgacccactgggcaggacacagaaggcttctgtgagaatgaagctctatcatgcttgtagaacatggagcgctcagcaaatacaaatcacagcccatctcctccaatcatttggggtattaggattcccttcactccaactcccactggaaaacctctttgccatgacacagagattccacaatcttctatttttatttaaaaatttttttaaagagtgatctttggttttctcagtagatgctttcctctgaatagcaagcatatagatagtcttctccttcagacccccgaccatggctatattatttagtctacagtggttctttgtacaaagtgcttctgcaaagctcttagagcacccagagctggctttggaaagcaagacattaggaatgagctagcctgaatgagtcctgatttttttttttttttttttttttttttgagatgatcttcttctgttgcccaggctggagtacagttgtacaatcttggctcatggcaacctcaaacttctgggctcaagccagccgcccatctcagctacttagtagcttggattatgggtttgtaccaccttgcctggctaatttgtatttttagtagagatgacattttgccatgttggccaggctggtcttgaactcctggcctcatgtgattgccccaacctcagcctcccaaagtgttgggattataggtgtgagcctctgtacctgagttctgatttcttaaatttcacagtcccttacctgtaactcaaattcccgaaccttcaaaaaacaacaagtggcagcaaaacttgatttggaattgtcgtggtcttgtttataatcgtcatttttcttgtcatgtgatttgatgtttgggtatatgttaacacctcactagggatatttcatagcatatgattgatgtaagtcgtaaaaaatttagaatccttcaacacatacttggattttagatgaagaatcatagatttttatttctgtggctttggatgagctgtttaattttcatttcaagttgctggtaagatgatgatgataatagagataatcctgtaagaatgctgcaaagggttagtactttattcttgcaacaagtatttattgtaggcctgtattcaaaggagaataagataaataagatcgaatgtggaaattagatgaatccggagttagtgcaatgaaagttactaagagagaacagaaatactcttgataatgctgatgtgactggacttttgacaagcagtctgggacttctgctgaaaagtgctcttgaagccaagcaaaatcatttccacaccctcagcacctccagtttttcctggccttggtctcagggtggttgaccttttgccgatgtgtttttcttttttcttttcttttgttttcttttcttttctcttctcttcttttcttttctaacagtcttgctctgtcttccaggctggagtgcagtggtgcgatctcagctcactgcagcctctgccccctgggttgaagcgattctcctgcctcagcctcccgagtacctgggactacaggctcccatcaccatgacaggctgattttcttttttttcgtaggacgaggtttcagcatgttcgccaggctggtcttggattcctgatctcacatgattcaccaaccttggcctcccaaagtgctgggattacaggtgtgagctaccgcacccagcctgctgatatatttttaattatcataagaaacagttaaagtgaaattgcaaccccatggtatcggtggactgaacgtttggttctcatttccttgagatggtagtttcctcctctggctacttttgtccagccagttctcctctgtgggcatttggggaagggctctctgatagaaatatgaaatgatgagggatgcaaaaaacgtggtttgtttcttagaacaacctccaccacgaaggttccagacagagtgaaatttctgtatttgctgaccctgtcgccagtagcctggaataaacagcaaaaatagttcttgaggcttcgtggcaaatgtgacctacctttgtagttcttgggtaggtgtgtgactgtggcctatgaggccaagttgcaaggtctttggatgaactttgtggcatctggcaatgtccccagtgcaacctatgtaaaatatagcagtttcctgcacacgcttaagggaagaaaccgttgtggggaagcgtgctctgttattcttgccaatgtagccaacatatacatggggaggtctgttttatgttttatgtttgatggttttttctttttctttcttttttttttttttgagacagggccttgctttgtcaccctggctcaagtgcagtggtagaatcatagctcactgcagcctcaaactctttggctccagtgattctcccacctcaacctcccaagtagctgggactacaggcgtgtaccaccatgaccagctaatcttttagtttttgtagagacaagttcttgctatgttgcccacagtaacatagtaagtctcaaattcctggcctcaagcgatcctccagccttgtcctcccaaagtactggattacaggcatgagtcactgcctggtgctttctttttgtctttttctaataaccattgctatagatggttgtccttaacgcgtaaatgtttaaaatacctaaatgcctaaacgtttgaaaacattccttaaaaattgaagttatagcatactaacaagtgttcatttttataattgctgatttaacttaataaaaaccaataactataaatatccttaatgccactgaattgttcacttaaagtggttaaaatgataaattttgttacgtatattttaccacaaattaaagaaaattaatatttccaacaagccaaagctctatgtaaatgtcctaaattaatgtgtttaaagagaaaatttcaccagtgataattttttttttttttcccctgagaaagtcttgctctgttgccaggctatagtgcactggcgtgatctcagctcactacaatctctgcctcctgggttcaagcaattctcctgcctcagcctcccgagtaggtgagactacaggcgcatgccaccaccgccagctaatttttgtatttttagtggagacgaggtttcaccgtgttggccgggatgctctcgatcttttgacctcgtgatccgcccgccttggcctcccatagtgctgggattataggcgtgaaccaccgtgcccggcagggagtaacatttctatgcaactatatgtgggtgtatttttctgaacatgtcagtgaagtttaaatattcatctcacttctttcagtcaccctcaaaggggaatttaatttacgacttcatttgtactttcaaacttcctcctggaaacagaagaaaataaaattagatttttgtaagctgagatgatatgcatgttcttattttcaatacagttagtctctccactttatttttaaacacaacctcataatacaaataatctagtcttttctggagcagtctatttattcagacaggtggaagttgatgctaaagattggcgttaaattgagtaaaccattcatgtagtaaataagataatttgtttctgccccccaaaagattaaaatatagatttttttcaaagtctgtttttttaacacctacggtccctgaatatgttcgattgaggtttgtgtctgtaatttggaacggctttttgttgcaactaaaatattcatttgcagaaattatcactgagggtgttagcttcttcatgcttgcgtttcttgcatttgttactaaataaaatatttagaagtcacgtcgattttcaaaatgatagttaaggatgaaggtaatattggcatatttatttttatctgtgtaatttttgcaacttataaccccttcaggtccaaatgaaacaggcaaccaggtaataaaccaattacattctaatacagattacttcatgacagtgtcttattttccagtttatatgtaggtgagattctttggagaccgtcttcgtaatatagctagtttttgtccattcattttgctttgacttccttgtataggtacaaaggtgtaagtaggagagtctaccaggcagcacacagacgtggccctgtaaccacccttgtgtaaaatcagagtaatcctccctatccttgcttatttcactgggttcatgggtgatgactgtaaatgacacaggagacagggaaagagttttgttatcctgatacacacattcttaaatgcctctagctgtgtagacattggtttgtccatattaatagtattttacgaagtgccagttgtgtgcctgctttgtggcatatgcattggcattcattgctttatttaattcttccaacaacgtgtcagatgtctgttcaaattattcccccctttacagacacagaaactaagatttagagaggttatgcaatgtgccaacagggagaagttggagctggaatttgaaccaggctagctgactccaaagctgtgtcctcaagcagtacatcagagccgaggaaggtcaagtttggaacgccatttagctgctctcagggagtctgattactgtttctctgttgaggctcagctcaagccttccctgggccatgaaagacaacttaggtttgggtgtcctgtgtttgtaccttgttttgtgcccacctacatcctgggttatgtctttccccaccccaagccttttttgccatctctttttcccagaaagactggaaacttgcctaaagagacagaatcccagatcccagatggatctactattttagaatctctgcttccgcatttctaaaatccttcccagagaattatttgactagttaaagcttaagaaacaccccagtggattatgagtgccttctagccaagaatgggtatttcctctgtgcaatctgagggcacgggacactcctccagcggagtagcctgtgatttgtatgggctgcatgaattcctgcactaacaaggtaaaagaaggatgttaaagaaaacccgagatcttttgggtacatgctataaggtgaaaggcttattccatttgctcaagaacaaacatccatttgtccaccccaagtatttatatagttcaattaagcgggcaggtaaactgattttttgggtggttaatgatctgatgattttcctctctgtcattgtgattggatatgataatctgagagttgcccaaattagtgcctttactgtagttataataatgtcatgatgactgaggatcactgagtgtgccttttgctctgttaagtgtgcattcagaactttactaacatgggttccacaggaaatattagccccattttgcaaatgaagaggctgaggctcagaaatttaaaattgcttcatgtcgcacagttcagtgtaaagttgcaatgcaaactaagatgtttccgttgcttataatcttaactataataatcataaaccatgttctgttgctcagaacccttgtacttataatataaaacaatctttttaaccaagattcttcgcttgggtattctgagtagcatggaagagcattatacttttttttttttttttttttttttgagacagagtctagctctgtcacccaggcctggagtgcagtggtgtgatctcggcacactgcaaccttcgcctcccaggttcaggcgattctcctgcctcagcctcctgggtagctgggactacaggagcatactcccacacccaggtaatttttcatttttggtagagacggcgtttcaccgtgttggccaggcttgtctcaacccctgagctcaggtgatccgcctgccttggcctgccaaagtgctgggattacagacatgagccaccaaacctggtcaattttctatggtgtgtgttacattttttaaaattttattttaatgtttatatagaaaaagttgccttatcaaccattataatcatggtatttagtgagtgtaatctgttctgatgtaatacttagtttaactggtaaaaaatattttgacagaatttaagattagttctttttgctttgtccgtcaatgtgaaataatcagtatatcatatttatagaattctgctaaaacatgcatatatacataaacagatattcatcttaattgatgttaattgagatataggagtacttcattaagtctccagaatacatacttcataagcaggaggcatatatgtttgtatatatgtatgtacatagacttgatacacatgaaataaaatttcaaatggttcctctgttcagcaaacgtgacccaaagttttggcttatttggcgttttgttttcttgaagacatacttgaattttaaatagttaatccatttaagaagtttcatttaaggtactgttaaaaagaaaaaacacagaacaacacagtgagagcagaaaaggtatcatctcctccccctcttcttctcttttagaaaccttgcgtgatccactgatggtaaatatttcatgtactttgcatatcagcctgagttccttttgtgaagtcaggtaaatggaatgtaaatcccctcgtcctccagacagtaaaacggcattatttgatgttacatcgcataaagatgcagatttgattccccctttactcacactataaaaacaaagtttttaaagtggttagccatacctggaaatgtaaatgcattcgcctaatgtaatgccaaagaaaaattaagacaaatgataccacatcgctgccacaaactgcggctcgtacaaaattcactttagttattatgctgtgaatacgggctctcaccctcctccgtgaatgcacaatttatgttgaatgcaacatgaatcattttaatagaccaagcaaaaagtccccaaagtcgattttcaaattatgaaccttggaacagaatataacaacagcgaacaacaaatagttcagactttactctgagctatgagtgaaccattaaagatacagcaagcactttcggtgaggtgttacacaattcatagcctaatggcaaaaatatcagaaatggggtattttttaatgctgtttttccagccatcattctgttcaattattttcacatttgtgtaatcaagatattcccaaacagaacatagagttgtgtattgttgggaactaattatatgtattataaatccaagaattaatttaaatgacccagtttccacagagaaaaagccacattgtttttaaatagctaactaaacaaaatgctaacccatatgggagaaatttccaaagaattaaaaccacccaccaggaaaatgggaaagtctcccctccacacacacacacacgcacacacacacacacacacacacatacacacacacacacacacacacaaaatcaccaaatcacacctgaacaagaggaagaaaattaaactcattgaggagataccatctttttttaaaaaaaaaaaaaaggcagcaaaatgtgagatgggcgtttattatgagatacacgaagacagagaccagaggttccccaagtagcccctggacctgcagtgtcagcatcacctggtagcttgttagacatagaaattcttgggctttattccacacataatgaatcagaagcttgtggggtggggcctgcagtctgaggtttattttttctaaaactttaagttccagggtacatgtgtaagatgtgcaagtttgttacataggtaatcatctgccacggtggtttgctgcagagatcaacttatcacctggatatgaagcccagcgtccattagctgttgttgctgatgctcttcccaccacctgcaagccccagtgtgtgttatccgcctccaccgtgtgtccatgtgttctcatcatgcagctcccacttataaacgagagcatgcagtgtttggttttcagtttctgcataagtttgcctaggataacggcttccagctccatccatgtccctgcagaggacatgatctctttcctttttatgattatataatattccatggtatatatgtaccatattttcttcatcctatcatttatgagcatttggagtgattccgtgtccttgctattgtgaaataccatttgacccagcaatcccattactgggtatgtaaccaaaggaatagaaatgattgtattataaaggtacatgcacatgtatgttgactgcagcagttttcacagtagaaaagacatggaattcacccaatccgaattttaacaagtcttccatgtgattctgagacagactcatgttcgtgtggttctggctctgcagaactgaggtgggccccaaaacttgcgtttctaaaaggtactagctgagcatgatgactcacatttgtaatcccaccactttgtgaggccgaggcgggtggatcgcttgaggccaggagtttgagaccagccttgccaacatggtgaaactccatctctactaaaaatataaaaatttgccgggtgtagtggtgcacacctgtagtcccagctatttggaaggctggggcaggagaatcgcttgaacctgggaggcagatgttgcagtgagccgagatcaggccactgcactccaacctgggtgacagagccagagtctgtctcaaaaaacgaaaaacaaaaaaaaccaaaagactaaatgtataaaaggtacccaggtgatgttgatgctacttgtcttggccaatgaaatgaaaagcctacaggccaggcatggtggctcatgcctgtgatccacaactttgggaggctgaggcaggcagatcacctgaagtcaagaattcaaaaccagcctgaccaacatggtgaaaccccatccctactaaaaatacaaaaataacaccaaaaaaaaaaaaaaaaaccacaacaaattagccaggtgtggtgatgtggcctatagtcccagctatttgggaggctgaggcaggagaatctcttgaatccaggaggtgaacgttgcagtgagccaagatctcaccactgcactctagcctgaacttcagagagagactatgtctcaaaaaaaaaaaaaaaaaaaagcctacagttgacaggcagataacagagggagcaaaggagtcttgtggaagacaatagggagtgttgaggacctgtcaaacaacacagtccccatctgtactttgggaggtaaggacttcttagttccagctgcctgttgccatgggggaacatagacccagagctgccatcttttctaatttttttaaaaattagaggctaaaagttttggcttataaaaatggtatttcctgagtttttacaattatagtattaagatattcctaggtttttgtttgttttcgagacgaagtttcgctctcatttcccaggatggagtgcagtggtgcaatctcctccgcctcccagtttaagccattctcctgcctcagcctcctgagtagctgggattacaggcgcccgccaccatgcccggctaattttttgtattttttagtacagacggggtttcagcatgttggccaggctggtctcaaactcctgacctcacgtgatccacccgccttggcctcctaaagggttgggattacaggtgtcagctagtgcacctgaccctaggataatcttaattttaagtagctggtaactcataaatttttaaacactctgcagttcaaagaaaacatgtttgtggtaggtagccagtttataacctgtgtaagactgtgttattagcaaatccctcaatgtgttgaccaagagtgggtaggaatcctgcagacagaatcttttgaaggtggtttgtttttttattcctttataagtacagttgtagatttacaaagtaattgagtatatagtacataaggtcttgtgtacccaccgatcgcaattgagcatatagtacatgctgtcctgtgtacccactgatccctggtcctgcccctggtatgagggtattaacatcttgcattagtgtggcacatttgctacaattaataaaccaatatcgatacattattaactagtctatagtttacatgaggggctgctgcttgtgttgtacattctataggtttgttcaatgcataatgacaggtgtctgtcatttcattatggagtgaaaccattccaatttcatacagcgtagtttcacgcctctaaaagtcccctgaaagtgttattaaaagtactatctggccatgtcctcatttccccagcaaagtccttctgagaatttaggcgctttaggctagaggatctcagtgctcagaatgaaatatccctgtactccaagatgcctccagcaattataattgaatcttgaagctagagtttcttggctatcctatttcccttttgtttccaccatgaagaagtggagagccgtgtgacctcagtggtagagctgatgtagaagcgccctctctgttcctggcagtgcctgtcctgctaacctcgtgtctcttgctggggtcttcatcagtaagagacctcacaagatgctttatcaggtcacttggcaaccaagctgatgaggatagcagtttcttttgttcttttaaaacatatataaaattatttttatcaaacatgacagatcaaaagccttctggaaaggagagatggtaactaatttaggcagtgtcttttgctttcacatggtgtacccagtactattaatatgaatttatcacatggaaacaaacttttaaaaaaattaattttgtgaattaaataaagcagcatgcaaatttactatcgtattcagcaaccaaaattttatcacttgcctgatactgcctagtgagcaggtggaaatgtagacaccaacaccctcatggattcccagctgctgagagtttgaatagtatgtgaagtctgtagagacaaaattgttgttttccccagttgtaaagtgtgcaatattatccttgcaaaattgtctgtttattttttttgcccttttgggggacaaaatgtctttatgttaaattgttttattattgttatctttatggagttaagggcacataaaatattcttacagagagaaattctgtagtttccacaagtaaccagagaattgttcaaggcagagaattattttttcaatgcctattttctcctgaattttctgacggagttagagataggaaaataccataatctgctataaattcagttgaaaaatagaaatagtgagaaatccaggttgtgctctgtcgtaatttaagcctaatatgtgattgtctacatgtttacaagttaccgcctttttatttcttctctttttctgttttcttcttccatttttatgttttgctatgccattcattcattctattcttttcatttctttttctttttgtaaaaattgtacagagtttaaagttagtcaggtatgtctattaaatttttacgtaaaaagttaaagcagccctcagcatcaacttcttcttcatttctaactcatttagtgaattcagttggtctttatatatgtagctttaagtaattgcatgtaaactgttacttcttcattttctagtcttagatattatctgtaggtttttcaataagaaggaaatttagcttccttctactttggtgccccatgatgatgtgcatcttttttatttctgcatcatatccatatagtgatatcatgtataatgatgtttaagaagacagttttttttgtttaaattgttataaataagtaagtgtatgcaccactatgccatgtagcatatcaagattatttttctttcctgcaccttattttttccctggagttaatactcatctttttttagaaatttgctgagtttgtgatgtacctatcattcaacctcaaactttcatgtgattgtctaaatctcagttccttttattagaaaaaaaaaaaaaaacaactcccctggagcctttgtaccttctgcagtttggggttgttgtcctttttgcttggtgcacaggaatacttggtgatgttctttttaaaactgccctcacattgtatcctggaaagttcatttacctgtacccggagttggaacttctcttccacatcttttcctgtattggtttggttattgttttgtgggagcatgtcttgtagtagctttctgaaaaaggatgatagaatatgtgtgtgtgtctgtgtgtgtgtatttcaggtttcaaaatgtttctgttccatcctcattttattcattgttagggatagaattacagatttaaaatcaattttgcttcagagttttaaattctattttgtggctttctgtgttgttctcgggaagtacaaacccttgtgaccgctgttctctttcatttctatctgcttctctcttgggagtacaatgggaggcatatcatcaaccccttgctgctatccaaataggagactgttccctttcaagagaattttaggtattcagatcctagacctcccagatggcctcataagtatttttatcctctatttatctttgtctttgtgttactttcagggatagttcttctagtctttccatggatttggtgggggggggggggacgtttctatttcctttatgtttgataacattctattcttgtttcatggatgatgttactcttttaactctctgatgttaatgataattgttttaatttttcttttctgtttagtttctatcttctcaaaattgttttcatttcttttggtaattgtgtttgatgatagtctttttttttttttgagatggagtcttactgtgtcacctaggctggagtgcagtggtgtgatcctgcctaactgcaacctccacctcccaggttcaagtgactgtcctgccttagcctcccaagtcgctgggactacatgtgcgtgtcaccaagccgaactaatttatttttattttttgtatttttagtagagatgaagtgtttaccctgttggccaggctggtcatgaactcctgacctcaggtgatctgcccatctcagcctcccaatgtgctaggattacaggcatgaaccaccacacctagcctcttgataaagtctttccccaaatgttctgatctgtggatgtctgtttctatctaagtagaattcaaagttactgctgccaactcttagcacatggccacggccagttaactgtggactcctctgaaggatgatctggctggactattttttgggaaaaccactgtgtttgaatgtttgcatgtgtcctgttggcagaacaaatatcccacagaaggatcttcttatcttctgcttggggaaggtgtagctctgactgctagagttctagagccaagtgagggggagagttctgagtctctgcattcagtaggtaaacatttacaaagtctgtgttttcagtatcatgccactgttctcacctgtttatgttctcttctgataataaacttctgtcatttttctggagttatgaaatgatggtatcctgctgggctgagtggggagggattctcaagctgtacatagctgacacacaggtttctaaaaggttgtctttcaaccccattttcagaagtaccaggttccacattttctgagcctttgctggctctctgataggaattgtgttacttctcagctgtccccatggctagcttaagactcagctctcttaagtcacttcctagttgtccatctgctttccagcatccaactgtaatttttttttttttaagagaaatgaagtctcattttgtttcccaggctggtctcactgtaattcctgggctcaagttacctctcaccttggcctcccaaactgctgggattataggcatgaatcgctgtgcctggcctcaactttaaatttttatattgaataatctttgatttgtattgtcatgttgttttatagcagttactgctgttttagtgtgatttgggatgaaaattttaaaaaatcaatatgtataatccaccatctttgttccttttatttttatgttactcattcttttaagcttgtcttagacgtgagtattatgttttattttgctgggagaacaatttgggaaaatttgagcagcaaaccataagtttcttggtgtctgtgtacttggagctctgaatcactattgtcactgagggagtggacaggaagtgatgctgagataagtctagatgggataggtgggcaacatgcaggagaaacctcctgggaaaggtgagcaagagcacacaggtgagacatagcatcgagtgtggaaacctccatgggtggcaggtcagtgttgctgagggatgtggacatgtctgaggccaaatagatgagtccctattgggttttgcctctccacaatctagaggaatatttatggaaggttaacagggcatggtggtgcacacctgtaattctagcacattgggaggctgaggtgagaggattgcttgtcttacaggagttgaagactagccttggcaacatagcaagacctcatctctacttggaaaaaaaaaattagctgggcatggtggtgctcacctatagtaccaggtacttcggaggctgaggcagcagaatggcttgagcctgggagatcaaggctacagtgagctgcaattgtgccactgcactctaatttaggcagcagaatgagactatgtctcaagaaaatgttcaagaagaaatacaaactattgaaaaaggaaggctgaatgctttatcagaaaactgtatttggaggggacctttctggggtcttttagtcagggtacataagtgtcagctgctacgacaaacaacttgcaacgtctcattatcttcatacaacaaacgctgatttgttcctttcattacatatccagtgtgagttggctggaaggtccaccctacacaaccactcgtgaaggcagacttgaaggggactccactgtcttggagctacactctaaaacaaatagcctccaaagtcaaggactctgtaacaggatgaagcagcattttttatgggcaggtttgcacgtggcatttgttgcttccatcaacattccactggcgagagtgagtccctggcccctatgtaattatgagggaggctgagatgtgagaagcacatgggtgttgggagagcactaaaggtctctagcccagaagcatgacttccagccaagtgagacagggaagcccagaaaaatgtgtcacagaacttatggcatcagaatctgattcccaggcatgctttccaccatatgcatagacatttgcaccccagggatagcaccattactcccaaaaattgcaggtttgaaagggtacctaaaaacaagccaccagattgtcccattccactatcattctgccatcaacaccgaggtgtcggagtagcaggagagccacatatttcttagtgaggggacccagaatgatcccttttgtgctagaggatctgagttcatttcatgaaactgaagcatcttcttggagatataagctcaccttgggataggcccttgcagatgacaataaaggtattttggcacataaaaaaactgctcagcacaccttgtatttgtatttcctttgacgtgaaccatggccatccagtaggccacgcaacattcccactgccatgttggcttgtttttcttttgttttcttgtcaacataagcctcatgagacaacagcaggatgcaagattgtacaatgacaccatgactctgctttctgggtgtcctctgtgggctctcagcagtgtccccgatgtggagggtcttcttattctgtgtgtgtgccctctgctgttgaaagttgcctgtcacccatgatgctgtgctgattgagcaaactaatccataacccaccgccacgttcctcgcctacttgcttctaggcacattaaacggtcagtgcacaggtcctcatttttctcatgcttccatttccatattctcaatcaatcactgatggccagctgtcaacaggcaccatttttggtgggacctgaagatgtatatcccttgttttcagattcctcgcctctcatcatgtaaggtgatgctctgagctgggtcttaaagcttctgggcacagccccccttgagtcttcattatggcaaatctagtgcaggtgctgagaggcggtaactctttaaagggacaggatatggaaacgtggcttcatggacagtattttagtatatttctgtaaatagcacatgtgctagatagcagatttgtgtatggatatgcacccggctagggacctctttaatggtcattcatttgggagatgacctttggttcctaaactggtggacataccaaggactaaaggagtgacttgctctcagttctttgtcattcagctgctttaatattaatatgacacccgttttgggcttgaaaagttttccttctgctgagaaatgatgatggtgacaatgatgacaatgacgatgacccttggttggagcaatgtagtctaaatgtggttgcatcatcttctttcttcctttgccttcctcccttgctctttttctgcccctcatgccggctccttcctcccacatcaccccacatttttttttctttctcctcaccatcaagaaatgttccagaatgccattattcttcgtcaccacggtcaggtatatcatcctaagggcagagggtgaaggtgcgtaattagtgtttcaccagactgagcatcatcctcgggcaggtgcaggggagaatggctggtatttatgagtgaatggcagcgttttgacaggatgatgaataaatatgctgggcccagaggactccaggtgataagcatttctttgtggtctggtaagtgatagcacccattgcttaatttctctaaaatctgcatttgtcaattttgtatttttttatttgaaaggtatttgcttaaataaataggccatataaatctagctcccaatgtccattttcaaatgatttccagcaaggaagatggaattaccacgaggaacctgttctcttatgtttctgcttagatggctgggtctataccagggtttatttaaatgaacacaggaaatgccattcacctttaccatgaatgggaatctttgcctgtgactctatcgtgtgaattagcagagcttggctattattcccctacttcggtagatactggctgtacagaagggaaccccagtttcaatgagtacctatgtgctgggcacttagctggtttttacacacatacttcatttgaagggaaggaattgactgaaaagaattctccattccaacttcccaagtcagttgccatttggccctgataaagctgtactttctcacttgttccttatttaaaatagagaaaagtgcatcaagctcttgttaatctgtcaggccttcctaagatgtctgaagaagttagtttggtgaacatgggcttcagggtcagactgcttgtgttccattcttgatcctatcacttccttgctgcgggaactctggaaagtcacttaacctctctgagcaagcttccatttttccaggtgaaaacgggagtttagcctagtccccacttgataagatggttgtggaaagtattgtgcgtcatggacctaaagtacctaggagattgtcctggatgtcgttttctcataaagttgactatggctattggtggtactagtatgactgtcaagtcgatcaggtggctgaggagcagtacatgggggtatacagagtgcaggcctcagaactgcagaacatctgcacaatctccagcaagctaacctctctggacatcgtattcctcatctataaaagggagacttcaatcttatttaatggcaaaagtcacaattacttttgtaccaacgtaatagaattaagtaaaataaggctagacatgctggctcatacctttaatcccagcactttgcgaggccaaggtgggcagattacttgagcccaggtgttggagaccagcctgagcaccatggcaaaaccccatcgctaccaaaaaaaaaaaaaaaaaaaaaaaaaaaaaaaaaaaattttagtcgggtgtaatggcacacctgtagtcccatctactcgggaggctgaggtgggaagtttgaacctgggaagtcaaggctacagtgagctgtgatcctgtctctacacctcagtctgggtggcagagcaagaccctgtctcaaaaaaaaaaaaaaaaaaaaaaaagtaaaataaagcatgggaagtcccttatacagtttgtgatatgggtacacactcagtgaaatggccattaatactgctgttcttaactctgaaagcagagtgggccatttgaatgctcactttgatattttttaaaggaaaaatttgaggcattgacacatgccttttgcttacttgcttggattggtttgatcaactttgttgcggtctaatttatgtaaaataaattgcatccatttaaatatacaattcaatgagttttgacagatgcacatgcccatgaaaccaacacgaaaataaaaaaaatagaacatttacatcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataattaccttgggatgtacccatactgctgcctgtatcagtggcttactcattgtcattggtgagtagtactccattgtgtggagaaatcacattgttttaaaaatacctaattacctgctgatagacatttgggttcttcccagtttttagctgttgtaaatggatactaatgtgaacgaagccaccgtgaatattgatgcactagtctttgtgtggacatatatctgttttatcttgggggataatactctggagtggaatgggcagggtggtccgtatagggctatgtataactttttaagaggttggcaaatacttccctaaagtggtcatcccattttacattcttgccaacagtgtttaaggatccacttcctctacatccttaataatacttgatattattggtcttctaaattttctgtttgggtacatagtggtattttgttgtatatttttttttaattgtgaaatatgtgagtatgatgagtaatgattttgaacatgaaaactatgcttattgctcatatctatgttattttattatttactttttttgagatggagtctcgctctgttgcccagtctggagagcagtggtgtgatcttggtttactgcaacctctgcctactgggttcaagcgattttcctgcctcagtctcttgagtagctggtgttacagaagcctgctaccatgcctggctaatttttgtgttgttttatttttattttatttttttagcagagacagggtttcaccatgttgaccaggctggtttcaactcctgacctcaggtgatctgcctgcctcggcctcccaaagtgctgggattacaggtgtgagccacagcgcccggtggtcatatctctttcttgcgtttttgtgggggttggggtaataggtttattgagatataattcatataccacacagtttcatttttagtgtattgacaggtgtgcagtcatcgtcacaatcaagccatagcttcttttaaactttgtcttccttctctttctaattatctccttcccccgccccctccattctctttccatcctttaaatgtcagtgtcccccacaattctgttgttgaccctttctccctctggccaatgctccttcccctgtagatcatacccattcccaagatttcagtcatcaaatccattccaatatgactcctgtatccatatgtctagttccaagtatctgtccatggtgttggtcccaggttattcgcacctcatatgtctttggcacagcactcttgacagctcataaagtcacgctgttacccccacaatgtccccccacatatcattgctatccctcctcgacacccacacctcttgcatgttcctgagcttcttaggcgtgttgcatcttcctgaccttcccagtccgaagcccaaggagatacttgataaatattcgtctaataaataaatgaacttgtgttctccatattccttgaaaatatgcttcacttttatctttttaagaaattaattgcattactatcttattaaaggtcaagaaaaataattcatatcactcactattcatgagactgctaaatagttgccctggcaatttctgattataattttagaaatatttctaacctctggccttttttcttatctctacttaaagcttttctggaaggaattcattttccactttccttaatgttccttaaatgttgtacatatcttaaaagtggattcctcataaaacaatatggactatggtcttattctgtttaacggtatgaaggctcgcctgaaaggccaagagtaagattcttttaaaatcatgcccaagttttaaaggaatataaaactttctctttaaaaatatacctttctgcttccatcccctaacccacaaagctcaagtctagtttaattcaaacttggaaatagttcttttattattgctccctgcaatgggaacagagctgaggctcctaaggtctagagtcaacatgaaaatacctttgcttctgggccatagctgtgtttcttcttaacaaggcagaagcccagaagagacttcatgtactgtgactgtaataaagagggttgtaagtagagaagctggaatttgaaaggttacgtacaagtcaagctgcctctgtaatgtcacttatatccaggaaagagtggcaaagaaccatcccagcagatagcttgagggtgggaagggggataggttgttgataatatggaataggagaaaaaagatcatagagccaaagagctcgatacatatactgatgcggtgtttattttattttagttttttgagacagggtctctgtcgctcaggctggattgagtgcagtgaatcttggctcactgtagcttttgcctcttgagctcaggcaatcctcctgcctcagccccaccagtagctgggactagaggcacatgccactacacccagttaattactacattttctgtagagacgggctttccccatgttgcccaggctggtctctaactcctgagctcaagagatccacccgcctctgcctcccaaagtgctaggattacaggtgtcagccacagtgccatgccctgatgtgatgcttaaattcagaaattgggaaggagggtcaggtagctataagcaaaatacaagagaaatataagagaaagaaagacttgtatctgttgttagtgagtttttgtggtggtgatacattaatggaggcaacagagggtcagaaatcagggtggaaaatagcccagcagaggggaaaagaggaagtctgaacgagggccacattgcagatagaggccggtgtactggtctgctcaggctgccataacaaaataccacaggctggataacttgaacaacaaaaatacattttctcatagttgtggagcctagaattccaaggtcaaggttccggcacagttgatgtcttctgaggtctacctcgtctgcttgcagacagccgccttcccaccgtgttctcacgtgacctagccgctgtgtgcacgcatccctggtttcttttcctgtgttcagatgtcctcttctttgaaggacaccactcagattgcaataggacctgccctgatagcctcattttttacataatcacctctttataggccgtacctccaaatacagtcacattctgaggtagtacgggttaggtcttcagcatatgaattttggggaaacagaatccagctaacaacagttggggatgaggctataacgaataccactgcctaatgtttgcacggggatatcatgcttttcagagaccatctgcatccttatctcacttaatccttgccccaccctttagaagaagccaggaggaggtcctagtcagctgatgtgagattacatggccctgactgtcttgcctggtgctgcaggccaccttcacagccttgccataccttttcccgtttatccatggattggtatgagccctaatggtgcacccttccgacaatccttcatccttcccagacgtttcatcagccaggtgaaatttgcaattgtttcagtgattgaaattatgcttggagtgcaggtgtcaccgatgaaacagcaatgccttgcggtgacaaattcagtgtagaaataattttagcaagcccagtgattggaaaacaatgactcaactttgagctatattgattttgtatttctgggctcagcttttgactcagtctcattccccagaaataatccctgttaacatttcggtttgtgttatggaagtgttctctcttctatgaattacctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaagtgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctcgatccttacacttagcatcatgttttcaagggtcattcatgttgtagcatgtatcagtacttctttttttagggctgagtaatattccatttacggatatgccacatttcatctatgcattcagttcacggacatgtaggttgtttccacattttggctattgtgcataatgcttccaggtacacttgtctacacatttttgtgtggatataggtttaccttttttggggtatgctcctaagagtgcaatttctggatcacgtggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattccgcagaaaaaagtactgattgtccagcagttgtgtcaggtagaaaactgggatgcccgactgcattggtttagccagaactatggccatgaaaccttgcctggcccccagggatggggtgaggggggatatcatatacgctttaggtggggcagaggggtggtctgcccctgtgcaggcaggaatgttcaggaagcaggctgcctctgtttctactctaaatatttaacattcacggatggcatggatcctgactaagcggagcagatgctggctctatattgcacatagctcctgaatatcagccctgcgtggctatgcatgtgttttttgttagtttttgagacagagtctcggtctcttgcccaggctggaatgcagtggcacgatgttggctcactgcaaaccctgcctcccaggttcaagcgattctcctctcccagcctcccgagtctctgggattacagacgtgtatcaccaggcccagctaatttttatatttttactcgagacgtagtttcaccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtggtggagatggtggcgcacaagagggtcagtgccccatctcaaggaacagctgcacctcggcctatgcgattgtgaaaatgtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcaatgttagtgacttagaaccacacaaaagttacactttacagttttggaggtcagtggtccaaaataggtctcagtgggctaaaatcgatgtgtcagcaggacaccatttctttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctgcttctgcttttaaggaaccttgtaacttcagggagtctaccctgataatctgggataatctgcctgtttgaaggtcagccaattagcaatcttaatgccatctacaaccttaattaccatttgctatgtaacatatttatagatatcagggattagttcatgaacatattggggtagagggcattccacatacagcagtacctataatgtatatgcttcttaaagaatgcatgagtcttaaatttattttatgtccttggagtgtatagcagagttagatagatccttctggattggcggttgattgaatattggctgtacaaagaaactggataggagtatagagaaaagatcaatcatagcactagcttatagtttattttattctttaatgattttttaaaaatatttctctcacttacttgaaaagcagtcttagaaattaactggaatgggtaatttattcgtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaaaagacacagatgaggctattaggattaagggaaaatcaagtaaatcgagaggtaaagcactgtgcagaaatattggccagaagctatgaacagatgccacagctgggctgaagagttacctgtgagccttccaggggtgtaagccaagagaaagacagttcaccaaatctatcgattaatagaaatcatccagcagcagtgccactgtaagatgttcaatacgtagcacctttctgtcccttctcctctagccagttgggacaggattagcaagccaaagactttctgaaataatccttagctatattcttggtattcaccaaggaatttaccaatatgcaaagacttggggataattagtattatctttgccattacctgcagtaatattatgaagattagagatgtaactctgtcctgaagaactgcagtctgtggctcaccttggagaagaacttaagaacttattgaagtgagcaggctcacctgcctttgctcagagccacatcacctgcaggcaggatctgcaaggtcagcagttagcgtcaagttgcacagcctgggcttgggtggcgttcgctttacccttgcccttgatgtggtgccgagttgtcaggattctcgtaaaattcctgggtgatggcttcttctgttctctttatttccttaagtgaacatctgtctaattgttcacctccatcgctttcgtgctttcctcatgctttctctctttccagacaataaactttattttcttcataagaattcagtctacgcaagggtattaggcagcttgtttgcaccttttaattcctggatgttttccagaaaggctgtttgcagtagttccagtgggttcatctgtgaatcaggaaagacaatgcagctttgtgttttggtttttatcagttaccttctgtttgtaaacatctgtttggaaacgtttgctggtgcccaccccagcacccccccacccctgccagaaataaagggattaatctctttttgcttggcatagggagaagacagtgtctgctgatgtgcttaacttttttttttttttggtcaggtgtgtaggtatgtgactgaaacccatagactttgcacatattgtcaaatgactttccagagggactcaggcactttatttaattaatgccaatgaagcccgttaatccgctcattactgcagtttaattttgatgctggtttttgatgatgtattgaaaacttgtataaactggcaattacaactggaaaacatttctagtttagaagagacccttatttttcatatgcttagaaatatccagcaagccacttttaaaggctttttatcacattttattcttaagctttctgaattccttattatattttgcctgataaatagttggattttgttttttggttcaatgtaagaatattcttaaactaggtaaactgttttgtttgtcattatgttctctcattctgttaaattttgttttctatttttcatgtttttgggtttttctagatggcctgtctttaacacttcttgatatttttgattaaattttcatatatcatcaaaaacagagatgacagccaggggtggtggtgcatgcctataatcccaacacttttggaggccaaggtgaggagaccacctgaggtcaggaattcaagactactgggcaacatggtgaagctctgtctatcctaaaaatgcaaaaattagccgggagtggtggtgcatgtctgtagtcacagctacttgggaggctgaggcaggcgaactgcttgaacctgggaggtggaggttgcagtgagctgagatggagccactgcactccagcctgggtcacagagggagactctgtctcaaaagaaaagaaaagtagagaggatagtataatgaggttcctgtctgccagtcactctatagtaactattaggaaacccctttttttctctgaagtcattgctcctgtgtgtgtgtgtgtctgtatataaaaaaaaagtatgtatacatatacgtatatgtatgtgtatagataaaaatgcgtgtatggtgctgggcgcagtggctcacgcctgtaatcccagcactttgggaggctgaggcgggcgaatcacgaggtcaggagatcgagaccatcctggctaacacggtgaaaccgtgtctctactaaaagtacaaaaaattagcctggcgtggtggcgggcacctgtagtcccagctactcgggaggctgagaccgaagaattacttgatgaaacatggcagacaacgtagaccagcagcaaactaccaacactgtggaggatcccctggatcttaggctcagcccagaggagcgaatttgtgtgaaaatgagaaacgaccgagagcttcgaggcagattacatacttatgatcaacatttaaatatgatcttgggagacgtggaagaaactgtgactactatagaaattgatgaggaaacatatgaagagacatatgaatcaacaaaacagaatattccagtgttctttctccggggagatggcattttcctggttgcccctccactgagagttggctgaaacaaagaatttgtcctgtacggaaaacaggagactttgtacagtggcctctctaaatgtgcaagatattcaaaagagaaacccgcatacatttggatattaagaaataattctggggattcttccactcctgaaatgagttgatttgcagataattcacaacttcttaagctaaatggtattttcgtttttctcaagctcttccaataaatatgaccaccaagatttttttttcctaaaaaaaaaaaaaaaaaaaaaagaagaatcgattgaacccgggaggtggaggttgcagtgagccaaggtcatgccactgcactccagcttgggcgacagagcgagactctgtctcaaaataaataaataaaaatgcatatatgtatatttgtgtgaatcatatacacatatataaaatatatgtatcatatacatatatatcacatttctttttctagtgtgtgtgtaccttgatttatgtctcacatattcaaaatactcaacttgtttaaaataagagcacaacctatttaagtagtaaagattcaaagccttcttctaaaatgcttaactttcctgtggatttgtggacccgtgggaaaatctcagtccccaggcaggaaggaaggagatatgacacatctctagtttgttgtaagtcgcctaccctagacctcatctccagtgctctgaatgtggagaggtaggtgcagggcagtgggacagagaggtgcactttgaaagactatcacatggaaacaaaagttccggctgggcacggtggctcacgcctgtaatccaagcactttgggaggccaaggcgagtggatcacgaggtcagcagttgaagaccagcctggccagcatggtgaaaccccgtctctactaaaaatagaaaaaattagccgggcatagtggcatgagcctgtaatcccagcgactcgggaggctgaggcaggagaatttcttgaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctttgcctcagtactactggcatttgctgacatccatttatcaagatacagggatggatttctagaaggcccaggcaggggtgctggccaggagacaccaggcatagaccttcctttctcagagccttcgtggcccctagtttgaatctttgagtcactgcagtaaagttcctgatgtttgagagtactccttatgaagggagtcatatgagttgctagctgggttctctggatggtggtgtcatgccaacatgggagccactagcacaaagaacatgctaggttctgttgagacctgactttgggaatagcataggtacttacctttctcagcaccacacaaacacactccagaatgcaaaggaacctgcactgtgccatcttgcttctccctgcatagccacttctctttccagtggtgtttgtattttggttcattcaatcaatgaatgattgattgaatcaaccacttggtcccttcaatctgtaaccttcctgcaacactgtctttgtgatgttatcataaccttgatttttgagggatagaattgggcataatcagagaaaacgtggtctgggacacatttgtgggctattctatgctaaacatttccatatcattaatgttcaacacagctttgtggtgttggagataggattatcattgttaggatggttattatcaatactagctgtgattattgatcacttccacatgccaggcacagtgctgggtgctacatatttattacctaatttatagcttgctgcactcttgctgggtatgtgtaattattcccatttcacccgatccctgggagtttggtgaattaatcacccagcatccaaatagctaaccagtagcagagctgggattcaaactcagttaggctgacttctgtgcctgttttcttgcctaagcggtggacgcattgagtaggagaaggccagttattcctctttgtcactgatacaactggggacctgttgccggagatgtggagctgtgcattagggctgggtagaacacacataatgaaccatatgcacgagaactttttcatctttctgcatacacttggaactagttctttgtttttgtaaaagcatcatgcactaggtaaaatgtttaataacacagagaaatctaattgtcaagtatcttctcaacacacattaatcaacaattctcctatcgaaagataacctcttgtatttacaaaaaaaagaagaaaaagtgctgtcatcagtaaattcattcatgtatgttatacactcacatacaaaacgtatctatttgattaaattagaactctgctaatgaattactttccttgattgcacagtaataaagtcaatgttgtaaatataataattatagccaagtgcagtggcttacacctgtaatcccggcactttgggaggctgaggtgggcagatcacttgaggtcaggagtttgagaccagcctggccaacatggtgaaaccctgtctctactaaaaatacaaaaattagctgggtgtggtggcacatgcctgtaatcccagctactcaggaagctgaggactgagaatcgcttgaacctgggaagtggagtttgcagtgagccgagatagttctactgcactccagcctgagcaacagagcaagactccgtgtcaaaaaataaataatatgtgtgtgtgtgtgtgtgtgtgtatgtacatgaattatatacaaatgagggaaaatatacaaatgagttgaatatatacaaatgagggaaaaattgttccttgtgtcaggaacaattactgtgaattttgtgtagctctttctgactttttaaaattcaaatatatttcataaagttgaaatcacactgtggtcttttttttttttttttttaaccagacatatagtggccatgtttctatgtcaatacatactgtttggcagtacagttgtactgacttgacattatagcttcataacttagtaaattaatcccttattgctgggcacagattctgttttccattttttcagtcatgagcaacgttgctggtttacctgggctaaataagaagtttaaatgcaaatagataatgcttgagaaagcttcttcccatatatactctttctgtagcagtgtctgagtgtctgtaccttcctataccttcaccatatcatgtatttgtcattttatagtgagttgtattacttgctaggtgagctggtatctcctctgataacacaaagaaggcctgggtttgcttggcaatttgttccaatattcttttcagttttaaataagttttgaacaaaaagttttagcattttacataaaaacctctaaagctctcaggctaattagtaatgtagcatatacaaattaagtttttttctgctgtgcttaattcttattaacacactaatcatgagagcccccaaattgctgtaaggagcacatttagaaaacatataaaggatcgatagttggtacttaagaaatcgttgaaacaccttttcttttttaatctatcttagagctgaaagataaaaagacttaaaatgagttagaatatgagtttttcagcatcttatagcttatgagttaaagcaagatttaaaaaatacatttaacatactaaatatttcaaaagctacagagataccgtaacatttaaaaaaataaattttcattgtggaaatcaactgccacaaaaacacaaccttttacgagacaacgtgatgtgcatgagaagccctgatgttgagaagctcataattcggtgtgagaaacacacaaggcatgatgccattcccatctgggatgaacagggaagacttcctgggagaggtgactatggacttaattttgttttgacacagcaaaaacatgaggaatgaattttgtgacttggaagattgttagttttctgtggagggaacaacactcatcttgcaaatttgccttcactattcaatcattagaaaataattttaaatgagcttagcagttctcagaattttggatttcaggaaacaaactttttaaaaacaaaacaaaaaggaggataccaatttaagcttgtcaaaaagattttcccccaaaagaaaaacacattaaaaacaacgacaaaaatcaacaaaaactaacactattcccccatcaacaatcaatattactttctaaaagcaagggcgttttgacaccagatattgtgaggacatccacctgctctaagggacagccatttcactggtgttctgtcaatttttattttgaactaattttagactcacatagaagttggagaagtaggctgggcacagtggctcatgcctgtaatcccagcactttgggaggccgaagcgggctgatcccttgaggccaggagttcaagaccagcctggtcaaatagtgaaatcctgtctctactaaaaatacaaaaattagcctggcatggcagcgcacacctgtaatcccagatacttgggaggctgagacatgagaatcacttgaagctgggagctggaggctgcagtgagccaagcggagtgccactgcactccagtctgggcgacagagtgagactctgtctcaaaaaaaaaaaaaagttgcagaaatagcaatatttcacagtacctctactttcttgtaattttagcagtttacctaatcatggtataataatcaaaactagaaaatagacaatggtgctaaatattaactatacttgttactcaaatttcaccactaaagcagtgtcatctttttattccaggatctagtccaggatgccacattatatttaattgttgtatctccttggtgcctttagtgctttttttttttgagacacggtctcactctgtcacccaggctggagcacagtggtacgatcatgggttactgcagcctccacctcctaggctcaagcgatcctcccacctcagtctcctgagtatctgggactatacgcatgcaccaccatgcctggctaatttttgcatttgttttatcaaggcagggtttcatcatgttgcacaggctggttttgagctcctgggctcaagaaatctgcttacctcggcttcccaaagtgctgggattacaggcatgagccactgcacctggcttggagcattcagtctttgatagttgcttacttatttccttctttctgatcttgagaccttgatttgtccagtattttctcatcattagctgagtgtaagcattttttggcaagaacattataaaaatgatgtggtgtctttcttagtatattatctcaggtagaacataatgttgatctgtctcatccctggtaatgttaaccttgatcacttggttaaggtgatgtctgctgagtttttccaatgtaatgttattaatttttcctttgaaattcataattatttgaagggagatgttttgagatgatgctggcagccccgttttccttaaactttcacatgctgactttctattgttggatcttgcctgcagcagtgtttaccatgatgcttggctagtggtgactatgtatttcccttactctttttatagtcagtaattggaattcttctgaagaaagagctatcccttctcccccatttctttcttttcttttctttttgttgagacaaagtttcactcctgtcgcccaggctggagtgtaatggtgcgatatcggctccctgcaacctctgcctcctgtgttcaggcgattctcccgtctcagcctcccaaggagctgggattacaggtccatgccaccatgcccagctaatttttatatttttagtagagatggggtttcaccactttgaccaggctggtctcaaactcctcttctctggtgatcctcccacctcggactcccaaagtgctgggattacaggtgtgagctacagcgcctggcccctcccccgtttatttctgattcaattactttatattagcgtagattcacaggtatttcctttttttttttttgatttattaatacctccatttattctgttgctgaaaccattccagctttttctggttggcttctatgaaggacgctattttaatggggtgatttttttcttctcactacattcttcctcactccccactttttatgtccggtggccataggctggtgagaacttgattttgaacagttgaaggtctgctgttagggacgtgctaatctagggaattgtactgaactcgtgggagcatgttagtatcagatgtgtgccttgtccgtcttgcttgtaggaagaacaagagacgagacacagcaaggtgatgatgggtatgtgaagcaggataaagaaaaaaacaggacaggcattacaggcttaagcctgtaatcccagcactttggaaggccaatgcgggtggatcacctgatgataggagttcaagaccagcctcaccaacatggtgaaaccctatccctattaaaaatacaaaaattaacaggcgtggtggcaggcatctgttgttccaggtactcgggaggctgaggcagcagaattgcctgaactcgggaggtggaggtagcagtgagctgagatggcaccactgcactccagcctgggcaatggagcaagactctatctaccccccaccctgcaaaaaaagaaaagaaaggaaaaaaaatcctggtgcttgtaggagaggcatttatttcttttaggactggacggggcttggagggtttccaggaaacagcctcaacctaaaaatagtagacacagttcatgaagaacttactatgtgtccagtagataaatataccacaagcattatcttctttaatcatctcacaatcttatgaaggagatactagtattttgcttgcaaagatgagggaagtgagtttccgaagttgctaaatgcgtaaaggaggtggtggtgtcagaatgttatcctgctcagatggttgcatgggacagtgtccagaggaaggcctctgattccttccccagcattaggcaatattcaagtcttcagttccatgtgtaggggagaagactttccttctgctccctaatgacagtggtacccacacccgtattccaccataaaatcttttttattcagtattaggaaaaaagaaacatctttccgtccagtggtcactgtgtgtgtatgtgtttgtgtgtgtgtgtgtgtatgtgtctgtgtgttcaccgtgctgtgtgaattgtggctttaaatgtattcctgtcaattccatatatttttaaaatgttgcttttagagtatgtgcaagtttggggcatttttgagggcttttttttttgacggggtcttaatatgtcacccaggctgcagtgcagtggcgcgatgacagcccactccagccccaaactcccaagctccagtgattttcctttctcagaccccaaagtagctgggaccacaggtgcacaccaccacttccagctgattatttaaaaaaaaattttgtagtgacagtgtcttgctgtgtttcccaggctgtccttgaactcctgggctcaactgatcttcccagcttggcctcccaaagtgctgggaatacaggtgtgagccactgtcccaggccagttttaactcagaatgatttcataagaaatccacatctgagagtcccagaaggtaagatattcccctttcttctaaatatacttgaccaccaccattcaggttcttctattaaccttcctatatttgccaaccctcaacctgttagaaacaagaaatgggactctggagtagatgttagcaacatcatgagctcaaacccctccagcttacagcggagacagtgaggtcctgtaggatgaggttggagagcaggaacttgcccgaggtcatgtgcagagttcgaggcagggcctggatgggaagcccagcatggagaccccaggccgtctctccgccatcttgttgtgatgcttccggaagaatgcctgtcactcttgctgacatccgactgaccaagtgggcaagaggaattcttcaaaacaatttaataaatgcttacattttctcttggccccgtgccacatccccccactcagtcttgttttcaaggttgaaggttccttcagagctagtgaccttgcccttcctggcctgtggatgtcgctctctatccgtaaccctcctttccagcgaccctgtttgcagcaaagactataattttattttgggtttggatatactgattacattttagcttctggtatattttcttacctgtcacagccattaaatttattttaatagttactctactctcctgatagccactaaagggggaattggatattgtctatcaattggttggtctctgaactaaggctgtatctaattacaaggcattgtatcggttctgatttattaaccatttacttggctttggagaaggcagcatttttagtagtactgttgagcctgcatgtagcttttccaggagggcagggtgcccggaatatctgatcttacagttattactttgtgtcatatataattttgttttctccctgcaacaaataaatctttgggactccggaagaaaaaaaaatgggaaagaaaaaaaaaatttgtggttacagtataataaaaataaactgtttgtcgtgactgcagctgacatttatcagcctgtttgtgggtgctctttctctataatacagaacataatttgtcactttgtaaatacattccagtctaaatccctgccagcatctgttagtgtttgaaggattaatgtgctaccctgtgtatgtctgcacttccagggaacagtgtagcatctgattacagatcgtgggagagcaggagggaacaaggtgttttctgtgctttttcctacatgcagtcgttttggcctttttctgatttttcttgtctttatcccattctgtctaggtacctggaatttcattctttacaaagatgttcctggtccccaacctttcttctgtctgtgatagtcacagctgaagtcatagtattttctgtgtactatgggttgagctgtgggtaattctttggggccggttagacttgggttcaaattctttctccaactagtttatgagcttaagttatgtgatttccatttcttcacttgcaaaatgaagatgctaatacctacttcttgaagatgctgaggttgagggaagaaataaatgttaatgcaaagtgcccagtttagtgcctgccaagagtaactggtgggtctgtgtcaccttctgacattatcagtgtgattgtctccaacgcatccatggaagtgaaaccgctggaggaagctaatgccgtgagccagctgttggttatgtttttgttttgtttttcttttttacttgctggatagtgggttctgtttattgagaaatatttacatccgtctaaatcaggtgcttgctagggttcttggcacacagagcatcccaccaataaactgtggttcccaacaaggcttgcaactgaatctgggcaacaatgaacatgacttcaataatgacaaaaagattcagattcctgctggaaggtccatatgtgctgtccccagtaggattctggaattccctgaatcatagtgttgcttgtaattctttccacattatgaagtggctctatagactgcctaccaccttgtatctactgctgtcgtttagattaggaacagattgccagatgtggaagaaatagcctcattagtaacttttctgtaagcaatctccttatttcttgttttttgttcttttgttttttgtgtgtgcttctgcgtgcccctcctctatggctccccccaccaaatttctgtgtcttcatttgcaactctcttttctccagtaaagaggaaagtgtatagttctcctttccttacagaaacattattttgttattgttgttttggtttgggtttctgaagtataaatgcatatgaactggacagaagtattatgcccatgtgccaggtggccaagatggggcttgtgatttgaagcttcttttcctagattcaggaaagtatcactggttaatcagggaatacatctttcggcccattggaaaatgtctgttcttagcaccctaaatgcccaggtattagcatacttgggaaatgtctagaaacccctatttcaatttactgaccatttttggtaaattcctagagatgccaaaatgcatttcaaaaagctttcatgttcaagaagacttgtggaatgatagaaaacatttaacgctgttatgtacgaagtgaaatactgttaaacttttagattatttaatagaagacacattttacaaggcaaagtgtttagatatgctccctcctatgcctatccacacatccttaactcttcacgttgtttgagactgttaggctgtttttttattgtatatttcatcaaatagtgggtgataaaacaacagacactctaaggaatggcatgacattctcctttcttctcctgcattcattggaacctgaatgtagtattaattataagactgttagacttcaggggactacactcttattctaaaatagtggtcaactaactgtgcccttcagacagaattcctgcccagcacctggctttgtaattaaagttttactggaacagaggaataccagttaatttatatctcgtctgttgccacttttgctttcatgctattaaagctgagtatttgggagatacttgaaaaatctaaaatgcttactatctggccctttagagaaaaggttttccaatctctgttctagaggattcgtggtcatttggaaagaaaagtatgttaagacaaaatgagcaggtggttggattagtattttctttctacacatatagaaactgttcctatcatacgtgactcagttttcaaacttgcttaatccaaagcctggggggtggatgtaggagagaagttgaaattagctggggttttttttttgtatcacaaaagttacattttttttttttttttttttttttttttaagacgtagtcttgctctgttgcccaggctggagtgcagtggtgtgatttcagctcacagcaagctctgcctcccaggtttacgccattctcctgcctcagcctcctaagtagctggtactacaggtgcctgccaccacgcccggctaattttttatatttttagtagagacagggtttcaccatgttagccactttggtctcaatctcctgacctcgtgattcaactgcctcgccctcccaaagtgctgggattacaggcgtgagccaccgcacccagccgaaaagttataattttaatggtctaaatcaaatttgttcaacctgcagcctgtgggcacatgtggcccaggacagctttgcagcccaacacaaatgtataaacttgcttaaaacatgatgagatattttttgccatttttttttcaactcatcagctatcattagggttagtgtattaatattttatgcacagcccaagataattctttgtccagtgtcacccagggaagccaaaagattggacaccctgggaataaaacagaaaaaaggtgtaaaaggcttcgagttcatggacagaacaacatttttgtaagtaaagtatttacggatgtggcccctttgtaatctcctgggctcagggataatttccaggctggggagaaggttgtgtcatggagacagcagtactgttttggaaggagaattgacttgtcacaatggacggagaactaccatcccatttgggccaacctcttttttttttttctttttgtttcgagatggagtctcgctctgtcaccaggctggagtgcagtggtgcaatctcagctcactgcaacctctgcctcccgagttcaagctattcttctgtctcagcctcctgagtagctgtgattacaggtgcgtgacaccacaccccgctaatttttgtatttttagtggagacgggatttcaccatgttggtcaggctggtgtcaaactcctgatcttaggtgatctgcctgcctcagcctcccaaagtgctgggattacaggtgtgagcctctgtgcccggcttctgccagcttctcattatgatttttgagcagatttcgctgctttttctgcctttgttgtgtttataaactagaagtaattatgtcaactttgtaagggctcagtagcgtagaataaggccatgtctgtaatctccccttctgtgaacagaggttatgttctcaaaagccttcaattaacatgagtggaatggattttctaaatttatatggaggagaaagttgtaggtcctatatgagtgatgacaggtgatacttaagttaactggaacatatggcccttagccacaatttccccacatgcccttctgggggatgctttgtagacctgatatcccagaaaggagtgtggactcataaagtcactgctgtcctttggttttcctgatgtaccaaatgtagtaaggcctcttttcaatgtggtaaaagctctgggccaccccataaggctgcaagcgctagaagctcttcccatagagaacatctatatcctcaaaccaaggagaaaaaggaagctgctgttcataaatattgaagaggcagggagagcttgcactgaggccagggtgtattaacatgcatgccatcgtgaagtggcttctaatggacatttgtaaggtggtgtcccctcccttcccctcccccctctaatgctgcctgggttgctctttgcaacacgtgcagtctgcaacttagctggcttttagcaaaattacccatcgcgattcatttgtcccattgggccatgggataggtgactacagagccagattcgaatgtggccctgtgccggtgcccaaaccagcaggctgcacgtgtgcactgacagaatggtacatcccaccactgctctgtgtctgtgtgcgactgtcagttgctctctactgctcctcatagacttcctgtctgcctttctctgcatttctcagtctccccatctccccttcttatctaatccccttccttcctctctcaactcttccttcctctatcctttttctttcccttttttttttaactattcttctttagagtttgttttctcattgaacttgtgatgtacacattaaaggaaaactcattaatgtggaaaattaggagcatcatagctaatgtatgctcagggcttactgtgtgctagacattattctgagtttacacagtgatgtcagatttctcctctgtcacagtaagttccaaaagatagtgaagaatattgcagtgaaaacactgaaactcacatatttcatactcaggggtatcttttaagtgtgaagcaagagaaaaaaacgtggaaaaaaaaagactcaggaaatgctttccatttagctttcttgactaagttagtggaagacttattccagattataaagagaagaaccaaaataaagagtttaagaatgaaggggtatgcagcaactggtagggtcgagtctcctcaggcacaacatgcaaccaaggaggggcagctcactcggcctgcgctggccacacaagtgcacctgccacagtattgaggggctggactgatttctcattaatgtctgggcaaaactcaaagaggcaaacattttcattacatactgttatccatcctattgtgggaccaatttctccagaaaggtctctctcggtgggaggattaataaacaccatcagaaatccaattaaacccaattgttaaaatccaacaaatacgttgcttgtggatacagttgtgtatagtaatgtgtatggtgatggcctatcatataggaatgatagaggcagcacagtgctgtaatggaaaccataagggcacgcacaatggctcatgcctgtaatcccagcactttgggaggccgaggcgggaggatcacataaggccaggagtttgagaccagcctggccaacatggtgaaaccccatctctactaaaactacaaaaatagccaggtgtcctggtgcatgtctgtaatcccagctacctgggaggctgaagcatcagaatcgcttcagcttgggagctggagcttgcagccagccaagatcacaccactgctctctatcctgggagacagagcaagactgtctccaaaaaaaaaaaaaaaaaaaagggcatggatctagatgccagacaatctgggtgcatatctttgctccaaaagcaaagattgtaaactctctttacaatctggggcaagttagctaatctctgcttcagtttgctccttagcaagatgggatgatattaccacttacctcagagagttgttaaatgggtaaattcatatgtaagtgttcttagagcagagttcagtacatagtaagtactgtgtaagaattggccatcattaatattattcattggataaatatcaaattcaaaataccgtttacattgggaaagggaaaaaggagagaaatatatgagagacgtatgctgggggtatctacgatgtttttttttttgatttttttatgtcattttaaatgtttctattcttctgttctgttcttaaagtatgcctgtaattattaggatataattatggattctgtcttatttattttttaatcttcttattgtgtctatcttttgtctttctccatattctgggagaaacatctaagtttccattccttataactgattatttttcttgggatcaattctggtcttcaccatctgccaatgtgagttttagtttctctataaacttttaaactttaaactttttttcttttttttttgggggggggggggcaatgcattcttaacccccttccagtttttctcagcctattcttgtttgtttttgttttctatttctgtttcattgagatgcatacaaaatggaagatggccaacatttctaaaaattttgtttcctgacatagagaacgtttagaggtcaggttgctctgagactgtgttgtgatttcttttttttttttttttacttgtttgtcctttcttttattatctcttgctgttatcctcacttttttctttgctgttcttcatcctttaattagcattcaaactaatcgttattagagtgtgtaacatgatctttgacatacctaggtaattttacttaagtatatgagttaagttgatacgcacagttcctcagcatgaatgtcattgttttgcaaattttagctgaaggtgacatcactgtactaaaattttcttgtgcatccacttcctagctatgactctctacagatggatataacttttttaagatgaaaaccatttattttcaatttctagtttaactgcctcacagtaaaaaagtgtactttttgtgatggcaggaatttgaagtatgttgaaactgcctttgtgatctggctcatggttaacttcaataacgtatgaaaagaatccatatttttatgtgtagtgttctgtagctcttttagttggtttatactcttttaatggtctgttgaccattttatctaaatattccattttgtcttttacttatttctattataaatggttaatctcttctactaagattgttaaatccatctttttgtttatggctgtgttatttggcacatgcaagttcatgattgttatatattcttgcttaattatttttccctttatgcatcatccatttttatctttagtgtttagtgttttttatttttattttgcctaaaattttatttttatgttaatatttgctatactagctattctgctttcaaaatgttcctgatgtttttctttatctttatcatttatcttttatctttaacatttttatatttctctcttttaatcatgtgtgttaggtaggcaaggatagctgctaggacaaaatattttctgatgttttaatagcttaacacaatggtaatttatttccagcttatgtaacagtgcttattgggcgctcagttgaggctggaaatagacatgtgagtgttttatggactaggccttgaagaagtgtacctcccttagatttatattccactggccaactctaagtctcacggctatgcctaattgtgaaggagactgggcaatgaatctagttgagtgccctgcaaactaaggcacagggatttttgtgaacagctggtagtctccattacagttctcacatctggacaacaagtaccttttgctcccttattctcacacagagaacatattcacttttcttccaaaggcagagtctcaaaatcccatttaattctttgattctgtgcaaattctagggtgtccttcatgcttagatatggttccttatggtcctgtgggtttcagaaaggcagcccattcatgccgtctacccccctgctgctctatataatagaaggtggagtagagacagaatatcagtagcaaaatctccattttcaaaagaaaagaatgagaaacatgttgctccatgacagtcaatgatagaatcacgctggggaggtaaagaaccttgtagtaagagagcattctttatccaggtctgaaatctgctctctggagggaagtgccctgtccattatcctccatggtcccatctgaactggatctagagaagggttactctccttaggggaattagcagctgtcagcccacttcctgctggtgcatggttgaggctccgtttttttgtttttagcagttataggcttttaaggtcagattaatctttatttaatttcttaataatcttataggattcagatgtatttgtttcccattaattcatgagtagtggccacaccagtctttcctagacttgaatctcaagttgctttatttttctaatttgttatcatcatgcctctctttcagcacagtagcagctactatgaggctatttggaataatgagcttggtttgaaaagtagcatcattaatctgatatatgctactgggctgaattatttgaattcataatgggctattgtctctcaaagacttttgcaggcttattttatgctttttggactccagaatcaattgactttttcaactctgtaatgtcctaactttcatttctgcttgcacactggacaatgctttttttcaggaacacatctctttcttgtaatatctttgtaaaagcagcgtggagcagccagcacacaatgacattttagctcttccctagagcttcagactcaataggtactagatctaccttatgagttatggcagagcacaattttaccaaaagtctttcagtgtaaagacacagatccacatgggtgtctctgattgacagttggctttgtctatttggtgagtaggatatccaagctcatttcatttagtggctgtattgtcccctaggaacttattataacttaacgtttatctcatggaaggttgaagtatggggaacccaattcatatgagaaatagcccaggagttacattctcttctgctcagtgaccattagtggaaatgtaaatatctcacctcaatgcagtgtgggttaggaaatgtggctttctgtctagtcaacctctttttcctatgctgtggaaagaggagaagtattctgagggacagctagttctatctgcagtgtatcttttttaaacagcatagaactattttttttttttaattctagtcttggtttctgcctttcaatgtgtgaatttaagttcatgtttcttttgatgactgataaatttgaaataatttctgtatttcattgtgttttcttcactaccaagtttttcttatttttaaacttttctgagcatatatatgtatattttttgagacagagtctcagtgtcacccaggctggaatgcagtggcttgatctcggctcactgcaaactctgcctcctgagttcaagcaatcctcccacctcagcctcccaagtagctgcattaaatacgtgtgccaccaggcccggccaatttttgtatttttagtagagatggaatttcaccatgttggccaggctggtcttgaactcctgacctcaagtggtctgcccgccttggcctcccacagtgtggggattataggcgtgagccattatgcctggccaccaggcatattttggaattgatagaatttctttttatctgagttactccatacatcattttttctccctgttgctcatttggaagctaatgattctttcctccctttcttcctttctgtctttctctgttttcctctctccctgttagtcttgaaagtcttacgtacatgtttaaattttttcttagagtatcaagttatttaatgtctatcattctaatcaacaaagccagaccatgcatgatttaatggatcagtgaaatccttccccccataaaacaaacttcacttgttagtgttgttttagttgcttcttaaattcattttcagtataatttatttggtcctgtagctactccaaatgacgcacaaaatttggctaaactgatgactctttttgtgtttatggtgttttgagtcctcaactttttctgtcttgaatttttttttttttttttttttttttttttttttttttttaaggcagagtttctgtctgtcgcccaggctggagtgcagtggcgcgatcttggctcactgcaagctccgcctcctcggttcatgccattctcctgcctcagcctcccgagtagctggaactacaggtgcccgccaccaggcctggctaattttttttgtattattagtagagatggggtttcaccgtgttagccaggatggtcttgatctcctgaccttgtggtccgtctgcctcggcctcccaaagtgctaagattacaggcacgagtctccgcacccggccctgtttttgcatttttagtagagacgggttttcaccaggttggccagcctggtctcaaactgttgaccttaggtgatctgcctacctcggcctcccaaagtgctgggataacaggcgtgagccactgcgcctgtctacattttctgtctttactggtattatggtgggaacccataaaccactgcgaggcagataccattttaagcaggaaaccttatttttttccgaagcacatttaaaaatattttccagtttatctattaaacatcctcctttgcttctggagatcctctgaaagatttatctctttcgattcatctgtaaagtaaaaataaccgtcgtcgtcatttctcaagcgtgacgatactgttacacgtttactgcatattctgcataccaagcacatatccgtcacacgcagtgtggccaacttccgagaggccggcattcagccaaacagcctgaagaaccaggagaaatgcctgagtttccaaatggcttatggtaagttgttgctgccactatgagtagcctacttgcatttctatttaatggcttttccccatatttgatggtatgttaaacagtcaatcattcattttctaaattaaagcctgtcctgaaaacgtgctcagtgctattgactgtgcatcaggtattagagacacagatatgaaactgtactttttaatttacgataaatgtcagtgtgaattattggttgttttgcttttctttcatagtctccgtaggcttcttgggaatggaaattggtataacctttttggaggaccctcagtaaaaagctatcaaaatttaaaatgtgggtatctcttgacctagtgagtctacttccaggaattcatcttaaagaaaaaaattatagtttcctaagtatttgtattgcagcattgctttcagtggccaacaaaacaaaacaaaacaaaattggaaacaacataaaataatattaccggagaaacaatgagtaacatgtataggatttttttttttttttttttgacggagtcttgctctgttgcccaggctcgagtgcagtggcatgatgttggctcactgcaactccgcatcctggtttcaagtggttcttctgcctcagccttccaattagcggggactaccagcgcatgtcaccatgcctggctaatttttgtatttttgtagagatggggtttcaccatcatggccaggctgttctcgaactcctgacctcaagtgatccacccgcttcagcctcccaaagtgctgggattacaggcatgagccaccacgcccagccgcttctcgtagatactacccaggaattttcacagtaacttcaaggaagagattgttctgtaatttctgtttttactgataaggaagctcacgcttagagaatgtaagtaaaaagttcacaaagctagtgaagtatgtgggggcggtttttaatgaatgattgaacattctttagtggaactacaatactatgtttttaggaaaagttgcacgatgtttttacatgggtagaaaatatactctggaaggatttgaaccaggctgtccctgttcttatcttggggcagtaggactttggggcacgttttcactttatatgttatcaacttctgtattatttgtaatacaatgaaccagttttatttttgcaactaacagtaagtataaatagctgatgaccacttggggtgaaccgaagtgcctatgacaaaccacacgcaggcatcctcgggactattgaggccagataatcctttgttatgggggctgttctgttcgttgtaagatattgagtagcatccctgacctctgccccctggatgccagttcactttccaacaagttgcaacaagcagaaatgtctgtagacattagcagatgtctgctagcagttagaatggcctctggttgagaatcagagcagactctgctcacactgggctatcagggtatagttctctccctcccaacagctggaactgagaccatctccctccatttgaggatcattccgatttcccaagtccaccgtgtggaatgtaaaatcctttgaaccagaacagacaaatcttgtttttgtctttttattgaatttaaccactattgacttgcgacttgcggcaatcaccagatcccagatctctgtgtttggagctacacgtctttctgaatcgaggaggtggggcactgatttttcttttatcactgacttccccgaagtgggaagttccagtgcttaacaagtttcattaagaacacagctattaaatattcagaatatacagactgttgctgttgagaatgtaattatgcagtaaattagctgatgtccagtacgttgccttttaagcagatctttgatgtatgcagtacttgcataagatatagggcatgtttattaagagtcttcaactgtgtataaaactagagcagtcaaaagtaatggtgtctgctgaaggattctttatcatatgaatttacctttagtcatctattatttatttcagctattttatatgccattataataaatattatgacagagaaagcttttacgcttcaacttattgtactcctctttacttgcctgcaatccttcaggaaaatgtaaccacgctttacctatagttaacgtaaatcatcacttacattagaatgaaaaattcactatgaaaaaaagctcttacttcaatagcaaggcataaatgcacaatcatgttgactgccaacctcctgtgtcattcactgtccttccttaaactgtttttaagctgcaaagtgaatatattgcatagagggaaataggaaggttttggattattttcgctctcttattagtttctggcaggataagcattttttatccggattgcaaaatattgccaattactgtctaagcatttttaatagttttgctttccatggcacgcaactcatatactaaattaaataagctgttatctggtgcaatttctccttgaatagacttagaattacctatagatattgacacggttattttataaattgagttccagcaacacaaggcaaaaattttggcctgtatgtaatgaaggaagagttgtcatcattttcttattagggatgtttgtgtattttggcagggggaggtaggaaggggacctgatggagggccctggagtgaaggttgatgctggatggttgatttgaaggttaggaatggcaaactcagcctctgttcttcaagaatccccctgcgtccccccgccctgccccctgcctaaaaaaaaggaaatccagggctttgctagggatcatttttggtgtggttctgtgttttaaaatgtggaatcatctccaaaagtgtttgtttattaaaagcaaagtgataaaatgtgtcaagtcagtgaagagactctcaaactcccctttcctgcgaatcctatcagaaagaacatttatgagggcatacttttcatctttaggcttggcaaagatgggtcaaactccccatcagactggcacatggtgctgtttcaggtttgactaagagagaaaagaatcactagtcaatgaaagcaactgtgtccccatgcattttccagtgaagatgcgatcacccattgccaccgttaccattacttaaataatattagaggaattagtgttatgaagtcccacatatgatattgatgaattattaaaccagttgagttagatttctattgtagttcagtgaataatgtcatgtcaatactgtgctcaacgccagtgtctcttgctgttgtaaatgtgacagctcctatttaaggttttagaacataaaatcaggactgagagtatgtaaagcggaagggtgagagacatcagcataatgcaattaaggcccattggattagaatttgcaggatgccattagcaataagctctgagtgtagattattgccgtgcttacattttctccttcagcggtaacacttctcttgtaaattctaactgggtaaaataaatatgatataaaacagacacaaataagaatatatagatgatgttaatttcttcagagcttcccggtgttacgtcttcaagaatatgacgacaggggaacagcccagtgtggcagtcatgtgacgacatgagcattggaaccagccacatctcagttggcaacacgtatctgtgtcttactagcttggccactgtcacgtcactcagcctctgttttctcatctgtaaaatggggaaaattatagatgcttcagaagatatttgctatcactattaaatgaaaacaagcatgtcatcagtgcttattatttttgttgcttttatgatcaataaatacatgcaaattagagctttttaaatgagattctggaaataagtttttccgtatgtgtaagggaggggtagatacactgccatccaatcagcatcaatgggtaccttgaagtgagatcacaaaatagctaattccctgtaaacagcaacccttctctctgcagttgcacatgagtagtcccccagttaaaagagaatttcctccagatacaatggaggccacgttcaacacagccatctagtgtacctgggcttcttccacctccagccactgtaccgacgtgttcctttatttcacccacatagtgatgatgcttccaacacagcataacaaagagctgctgctttgtgctgctagatttgccaaaagtctgtgccagggattcttttgttggaggtaagtggagaacgcaaggcccacatgcacaagatgggagtattttgaagcatgctccgtaagacccaacatgtgggcagcagaccaactacttgggttcactatggcgagaaatgggataggagagcgaactcactgataccctcccagctaattcctaggcaatctgcaattaacaatgattgtaaagtaataatttgtggttttgaaaactaggtttgatcactggaattattcctgtcctatgttctaaaggcctgttgccttgagatgttttttctcctcccattattggtaagcataatgtaggcatgagacgttgcctttgaagtgtcggaaggatggagaggagaaaagaaaacggagattgaatctggaaaacgcattcatctttagaggcagtgttaatgagtacatgaatttagtcctgtaaatgttttctcccttatttgggacatggtgtattgaaggtgtctgttaactgtgctaccaatgagtgcccctgtatccgagggaaactggagaagtgtacttgggctaccgggttaccaagagcaggacagcatgaggcagttacagatctgatggtttttcttggtctttgtctcagctgccatgagggcttctaaggggcaaggagggttgggggatgagaggacaggtacatagtgtggacataatggaatatggaatagcaattgaaatcttgcgttgggctgaatcatggctttgcagttattatcttgatgcggctgtgcatgagccttttgaacctcagcttctccatctgtgaaataggtggataatgactgcaccctgcgaagatgctatagggataaataactgctgtggggcaaggactgaaatggttgttgttttgagatggcttttatcattgggccagtgacgacccattcagccgtatcagtgaagagtgaagcactgcactctttaaggatagggctgaatggtttatcacccattcagcggtgaccaccacatcttatgcattgtgatgatcacgatgataaaacaatacataatcacaatataaggatctagagttatgaactactgatcaggtatcatgttctgctccaactgctttagatacattgcctgacttcccgatagggcaggtgctgttattactcccacttcacagaggagcaaactaaatatacaagaagcagtaacttgcccagccccaaaccaccccctgaaaaaagaaaacaagggagacccacagttattaatatgcattattattggaaaacaatggtcatcacattttagcagtggccttcaaaataatgataatagcatatattgagagcccattgtgtggcttgtaccttatattcactctatctaatcttcactctaaccatagaaggcaatactattatgctcattcataattaaggcaattgaagcccagatccttccagtagctttcctgaagtcaagttgccagtgcattggacatactgggctgtagttccagggcagcctggctctggtgtctttgctgcaatgacaatatctccccatttctctgtttaaataccacacactccccatatggtttctttggtttcaggcagtatcgcatcagagtcacatatggctaatttatagtcataaaatgatactagagatcactgttgcataacaacaagaaacccctttgattccacacttacagactcttgagtcactaacacaggtttcagtatatataaagaatagatgaagaagacttagtgtattaaggtggcagtgaactgtgctactgatgagtgccactatattcaagggaaatgggagacatgcacctgggttgtttgattatgaccttctggctgagccctggatgttgggagcaagtgggcttctgagctacatagaagttgcctgatgcttcacatgtgggatgccacctgtgtggctctgttttaaaatgatgggtaggtagagtctgtatacataatttaaaatacattaacatttctgttttgcctgagataagcttgtactggtgtgatcagaaggaagaatgaagatttggggaaggaaaattttgagagccattttacagcatttcaagattcagtgatctcagaacctcttttggttaaacaagcatgggaggatggatgattggatggatggatgaatggataggtaggtgggaagataaatggatagacatataggtaggaaggaatgagggatatatggaaggctagcagtttattttacggtggtgggatttttttcttttccttttttactcagacagtcttgttctgttgcccaggctggagtgcagtggcacgatcatgtctcacggcagcctcgactttccaggttcaagtgatcttcctgccgcagcctcctgtgtagcaggtgcatgctgctatgcccagccagttatattttagatgcttttttatatggcccatattcatatgtctttgtgacttttttttataatggatgtgagtgtgaagtaggagttggcctgaaacaagcccagagaggtagacagggaccaagtcatggactgagttagttgttgttgttcctcactttctgtttttatttctcctctttctggacacatagcacgttgcaccttctagaagctaggcacagccacatgactttgtcaaggaaatgtgagcagaagcaacaccagtcactattaagtggaagtctttgagatgccacgtgtaactcaccacattgccttccacatgccgtagaggctggcagtgttacagacaacagaggctccatccacctggtccctgagtggccacggtgagctgggcccactgacctacaatgagtgtgaagtgtgagcaagtcataattctgggttattctaattaatggagatttgggggttgttccttactgaagcacatcctgattgatgcagaggatcttgtgagccatgctaaggaattcagcccacgtcttactgaccactctgacgtactaaagggttggttttgccaatgaagagagcaggctctgactgaacgaggcctgaacttttcatgttctagatggcatgtgctaattctaacacttcttaatgaaagtcatggtttgcttggtggtgatggaacagttctatgtcttgaatgtggtgatggttatatgaatacatacacatgataaaatgtcttagaattatgcacaaaggtacagcaaagaaaataaacgcatctcaagttgtgttagttccttctcacactgctatataaacatacctgagactgtgtaatttataaagaaagcaggtttaattggctcattgttctgtgttcatgttctgcttctggataggccttaggaaacttccaatcatggcgaagaggaagcaggcaaatcttagcaggagcaggaggacgaatagggggaggtgatatgctcttgtaaacaagcagatcttaggcatactggatcacgagacagcactagggggatggcactaagctgtttttaaccagccccatgatccaatcacctcccaccaggccccacctccagtattggggattacaatttaatatgagatttgggtagggacacagagccaaaccacatcaggtgacatcccagtaatgactgtggtctagtaaattgtgttgtgttgatgttgattttcaggttttgccattgtattgtatgtatgtaagatgtatatatgggggaagctggatgatgggtatagggtgttctctgtaccagtttggccatgttttgtgaatctataattagtttcaaataaaagttaacaaccagaagatcatgagctaaaccaataaagtgaattatggtcagttgcagattcactgccagacctgggaggaaatctcaccttggcagatcgagtctcttgtcctcgcctaacaatcagcagttcacctctcgaaaaggggttccgtttgcaatctgtcagccactaccttcttatttagagcatgtcccactacaaacatttctataaagttactaagtttgttagacaattagaattgcaaacccccaacacacacataaacacatatgcacaccctaatttaaaggctgcattttccatcccctggacttactgtattgcctccagtttctctccatttctcaggattggtagcagaaatgggaaacctgatacctagggcaagagaattgcctgaataacagtgtgtggacttgaatcactatccccaggagcctagtaacccacagcttgtggattagtctgttgaactacttgatggcttgtgacccctttttcccttagagttatatgttctgattttcttcttattgatagtggcagctctgtgctttattttgaagggaagcaggggaaccaaaagaaaacttagcagttgtaagttacttacagagaagactgggctagttggctgtgctatcatttttgttgaaatactgctttggggtcgccatctgggaatgttcttcctgttttatgggggaaatacatacatgcgtttttataatatgtagcctgcatatcccttggggtttccactgggggcttggctgagcagagcaatttctttaccaccccctccacagcataatgaatggctgcctttcctcttgtgatacattcacatttctgtaagattctgcacgtggcagtgagtgtcatgctccaagtaaaacgaggcagggaccagaggacttaggatgaggatgaaaggtcactttgtttgctgactctgaatgtcaggtagttgtgtttatgaggcatcagcgtctctgtggggtattgaaacatttacactttgaaaatatttttaatcatcagataaatatcagttactcagacagcttatgagggttctgctcctcatctggaggtacacacctttcacggggtgtgacttcaccacatgccttcaatattcttggtggcagttgccctctttataggggggatgtggcgtcaccttatagcagaccctctagctctgttatttcctgaacgtaggaaactaacaacccacgtgtgggcgttttccccttttcctagatcaggttcatgtttctcctcctcgttccaaaatctgcacactttggcatctgccactgttacccaagaccaggaatttaaatctgtgtttgccagtttgcctccaccactgatgtgctgttggggtttggggacataatttcatcactttctaccacctttccttaaaactaggctttgtgccaggtgcggtggctcacgcctgtaatcctagcactttcggaggccggggtgggtggatcacaaggtcaagagattgagaccatcctggccaacatggtgaaaccccgtctgtactgaaaatacaaaaataagctgggtgtgttggcacgcacctgtagtcccagctagtcgggaggctgaggcaggagaatcgcttgagcccaggaagtggaggttgcagtgagccaagatggtgccactgcacttcagcctgggcgacagagtgagactccatctaaacacacacacacacacacacacacacaaaagcacagggctttgttagcaggcatgacttggattctttaggatccttccctcagtaatctggtctgatgtggccttcagggaggatctttggacatcattgccatccatctgtccactgtgctggactataacccacccagactaccatttattgccaagtggcatcgggacaagagttttacacaagaaacatcttctctgctagttaaattaattagataatttgtcttccagacaggatgttaggaacttatgaacatgtatcgttacaaacctatgagtagatgactaatattcatcttttacagataaggaaactgaggctcaacagtgttaaatggtccagaatgagtgtgttttctagctgtcactgcctgatgtttactgctcaaagcttaggacttggattagagcccaggacttggcagccaagataaaccagctgcaattacgctgaacgtctcagcccagctcctgtccatccctgaacaggacacttagggtagaggatgttctcagcagtgccatttgcatcccccttcatagccttacaggtatcatgttatcctccttaatcttacttaagcatcacagtctagactagaattcccaagtcaaccgtttgttttacgggactcttcttatttgaataggcaggtggccctgtgttcttgggttttttgtcctttcaaggagctaggtctaagaagtgatagtatttaatctcgcactccgaagcgcacccagatttaaaagttgggagtggcccatacacagaaggctagtgggaggggcaacccggagatttgtccttgcagaatgatgccatgaagaacatggccaatggaacaccattgcttcaaatcccgacctctccagttctcctggtttcttgctaggcgggaacttgggcttctttatcagtgactggggtcagttcttgtactcaatttcctatctctgtgatctcttgtaagatgctgcattgtcaaatggagaaaacattgtctttgagttgttaggagccttgagtgagatggtatgcaaatgtccagcccgtggcaggccctaagtacacagtagccattattaccattattattcctatcaccagcatgtattccacctgttgatagagttttctgggtttactaagccagggtgttgcctttgggatcgaggtccgtcagaatccattggtataaacgagtctttctgcttttgtactttctataaaggagttgtctttgatttttgatgcaggtttaatggagatatttcagaacctggatggcagcttttgaaattaagatattgtccattgcatctttccatgatcgaggcgttgtcgtgcattcccctccttacagcgttttaggatgcagattgagaggagataacgttagcccgaagcgcctttgcagcctcttttgcgcggctgaaacacagcacaacccacccccccgccccaccccccagcctgtaggtttagcagaatcccagcctcacatcctccccgaacttggcagtaaaagccctgttcttccattcattccgatgatttatattctctctgggcgtcttatattaaacaggggaattccgacatgttccataacacatttactgtaacttgataccatgaactacacttgctgttatttatcatttctttttattttctctcattgcagcataaagccaaggtagaagcaatgaccctggacctcgctctgctccgtagcgtgcagcattttgctgaagcattcaaggccaagaatgtgtgagtgttccagtggagggttatagatcataatttcttgctattgtaatatctttatcagatgaacacaattgggagaatgcaaggctgttgtgttgtcttggcgtccaaacaggaggctcatttatattggccctgttaaggtgaaccgtattttcttgactcacagtcaccttcattatgagatgtgtcatcaatctaataacagcttcccacataccaaaagagaagacactattaaagcactagtaaaagtggctaataaaagcttggcaatagtaagatgcatcctgattataagattttttgtagtgcatttcagaatggagtaagagtatatttaaattgcattcaggaacaagtaaactcagttatccagtatggcagggaggttgacaatccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagagaaggttgtaggagaaagggagagaagcggaagggggtggggagacagagagacagacaggaggcctcaaaccctgaaacactgagctaaggaaagtgatcatggcaagctacactaattacaatactttgtttccaagtgtttatttttactcatatttagggcaggcaatcctggtttctcgttgaacatagaggtttgaatttcattaataaataacttcatttattttttttcagtgacttgattcaaacatgaggattaagttaataatagcacaggttgtgcgaaggataagataattacacaagaggcaccagaaccactgaatgtggagagctctcataaatgacaagctgcctttgggttaggctctgttgggaacattagttctgcagtgttgcaagcagatgaaggatgtgagggaagggatcttaaaccagatattcaaatggccctgtggggagctgacaccacactgctgtctagtgtccaattctccttgcatggctgtgtcacccaggttggaacgtagtgcacaatctcgccttaatgcaacgtcccactgtgggcccaagtgattttcctgtcccagcctcctgagtagctgggactacagatgcctgccaccatggcctgctaatttttgtatttttagtagacatagggtttcaccatattggtcagactggtctcaaactcctggcctcaggtgatccacccgcctcagcctctgaaaatgctgggattacacacatgaaccactgcgcccagccgctctactttattagatttaaaaagtttgctctcagctgggtgcagtggcttatgcctgtaatcccagcagtttgggaggccaaggcggggagggtcatgaggtcaagagatcaagaccatcctggccaacattgtgaaaccccatctctactaaagatacaaaaaattagctgggtgtagtggtgcacacctctagtcctagctacttgggaggctgaggcaggaaaatcgcttgaacctgggaggcagaggttgcagtgagccaagatggcaccactgcactccagcctggcgacagattgagactccgtctcaaaaaaaaaaaaaaaaaaaaaaaaaaaaaaaagtttgtactcagcctggcgtggtggctcacgcctgtaatcccagcactttgtgaggccgaggtgggcggatcacctgaagtcaggagttcgagaccagcctgggcaacaaggtaaaaccccgtctctactaaaaatgcaaaattaactgggcggggaggcacatgcctgtaatcccagctacttgggaggctgaggcaggagaatggcttgaacccgggaggtggaggttgcagtgagctgagactgaaccagtgcactccagcccgggtgacaagagcaaaactctgtctcaaaaaaaaaaaaaaaaattgactcaggctcttgctggagtatgtcagtgtcccaagtcactgaggtctacattagagtcagtcttagtgagagttgcaacatcgcctaagcgcagaccccaagctggcttgtaggaacagtgagataacatcccccagccagccagatctgagagagccctcctgtgtgtgtcctttgcagcgcttggctgttagtagcttccaccctttgccagaactatcaagaggcacctcaacaggctgcaacactagcattcaagacatttgttcgctgatttgcttcgtcattcatttatccacccgttccttcacttcacacacatttcaggagcacctctaaagccccagacattcttctgggctctgagaagagagtggtggccctggaagccacagtaaccgcacacaagctgtcacctcagttgtcagctattatggatggctgactcctcaaactcatctgtctgtggttgtttgggagggaatgataatgacaagaacagcagcggagtcagcagctcatttactgagggcttatgggccatacgtggaaaatattttgcatgtatgttttgattcaattctcaaagcagtccttgggagtagatgctattaatatctctactatacagataaggaaagtgaggctagagaggatatataatttatccaaggcatgtggaatgtgggtagaggggccgatttagcctcttcacggctccaacttgaccaccgtactatactgtgtttcattttagtttattttttatttattttttgagacagggtctcgctgtgttgcccaggctgaagtgcagtggtgcaatctctgttcattgcaacctctggccttgggttcaagcgattctcatgcctcatcctccagagtagctgggattacaggtgcaggttaccacacacagctaatttttgtattttctgtagagatgaggtttcaccatgttggccaggctagtcaactcctgacctcaagtgatctctccaccttggcctcccaaactgctggaattacaggcgtgagccaccctgcccgaccctttcattttaaatgtgatagaaacagactcagagaatgtgagtgactttcgcagggtcacttagcaggttggtgacgggcatggggtttcactccagtctgcctcttgttcttttcctcatagcatgtgagatctcacaattcactgccgctgaataactttgtccagttcctctgtcagaatgtgttggaagtgagcagctttgctgaagagagccaactgttacataataggatcatcttccacgtcttaactggaccattagtttttaaccattaagtagttgggaaatcatcaagttcaagtgccttttgtaatcaccaagctcaaaaccttggaggaaactctcacccattttgccctaatcccagattttagcacaggactttggaattttagaaagtacttctaggttgagaaacaagggtgattttccatatagagacctctgtagcacaaccctctttgtatgtgtcccatgagagtacaggattttacatggcttagagaaatactgtggtggtgaaaatatgcataaaaaagcgagagattttacttttgaaatgctgccaaagtgaaatctctcttggataggcagatgacagtttagtacttgcaggtctttcgattctgacaactgtcagaagtgaatttaagtgctggtgactaggctgccagagaaacacatgtaactctattcttatcaccccccatcttcagacattaaaattttcttgtgtgtaaaacataatgacaaatgaaagaaaggctgccagttcagaaccaatctcttttcacgctgttgcattgaggagaggaaaaaatcccttaaatttgaattccatgtggatgctcttatttaatatgccgtttcaaagcctgtatgtgatcaagccagagtattatcaggctctgagttcctgtgtgtattcccttggtccatgctccatctcaagtgtttctccacactgggataggcagcatattgtgtagtcttagagcagaaaaggtagaaacagattcttagtacaaacactggtgagaaaagcagcatattgtactgtggaaccacccgccgtctgccttctgtgggagatggggatcagcctcttcctggatctcttctttttattcgggtgctgggaggtgaggctgcaaaggaggctgttgtagagggagccctcctaaccatgattatgtaaacaatagctgctaggcaacttgttgtttgttttatgcaaggcagtgtgctaagcacttacatacatgtattctgtctgtagtttgttataagagtcctgcacacttaaccatgattatccctactttgcaaattacaaggttgcagtgcagagagcctaagacactttctcaacttgagcaagtaggagatccagaatttgaacccaaatctctctgaatccaaaacgactttttgttactttgcacacttcagtcataggaatttcagtgtggatttctgtattggttatgtattgccgagtaagaaatgactctggccaggcacggtggctcacacatgtaatcccagcacctggggaggccgcagtgggtggattgcttgaggccaggagtttgagaacagcctggccaacatggcaaaaccccgtctgtactaaaaatacaaaaattagccgggcatggtgatgcatacctgaagtcccagctactcaggaggctgaggcatgagaattgcttgagctctggggtgggcagaggttgcagtgagccgagatcatgcctgggggacagtgagactctgtctcaaacaaattactccaaaatttagtggctaaaaaacaacgtaaaacaagaaacatttcttttgtgcctcctcttttcctccctccctctttctcatagttaatttgtttgaatcaggattcaaataaggtcgatgcatttttaatctataggttttgtctcctttttttttttttccttaaaaaaatttcttttaatgcaacagatttaagggaccagggtgttctctagagcaggggtccatgacctctaggccacaaaccaatagcggagccgtggcctgttataaattgggtggcatggcagggagtgagtggtgggcaagcataggaagctgcgtctgtgcttagagccgctctctgtcactctcattagtgcctcaggtcctccccctgtcagatcagcaacagcattagtctcataggaccgtgatccctattgtgagccacacatgcaagggatctaggctgcatgctccttacgaaaatctaatgcctgatgatctgtcactgcctcccatcaccttcaagatgggattgtctagttctaggaaaacaagctcagggctcccaccgattgtacattatggtgagttggataactatttcattatatattacaacgtaataataatagaaataaagtgcacaataaatgtcatctgcttgaatcgtcccaaagccacccccactcctttgagtctatggaaaaattgtcttccagaaaaccacttgctggtgccaaaaaaatttggaaacctctgctctagagatttctgcagtctgtactttggtgattgcatctctgtggtgtcttttaacatactcttctgtctcctgagtttcctgtgaaagggtagataactcaagagactcaatcaacttcgtgtttaatgttttcgtaagaatacttcagaggcagtggtgtaatcgtccaagagtacacacaggcctgattgccaaagccagttttcttcaggcccagcacgtcctgacctcctcactcctctgcccactctctgtttactcactcccattttcattcattgattctgttattctccactaagttttctgggtggtcagcccaggaagcctcagcctgcttccagatagttctcctcagagttagcggtagcagcggtcgtcggccagtgtgtctcgggtcaaattattttgggcattactggaaagttccaaaccaaagcctgtggtaagttccacccaaactggcttgtgagggatatttttgtttaaactgcattcctggagaggagccagacttcctactgcctggcagcagtggtgtccataggagtatgaagagctgggaccctttctaatcactcagaccaaatattggggttttctgaaatggactgagaaataacagtatgtttttatgaggctttgcacattttccttcctagcagtagctgcttagtctactgaaaagtgcatattttgaacagggcctagaagagttaacagctcctagagagaggtgctctgtaatactttttcttcttcaaaaaatggtttatggctgggcgcaatggttcatgcctataatcccagcgcttttgggaggccaaggtgagaggattgcttaagcccagaaacgtgagaccagcctgggcaacgtagtgagacgctgtctctatattacaaaattttttaaaaaacggtttgtaggtccttaagtccctgataaaatagagaactgaattgcaatcctggaacttaaaaagttggtgacgacacctgagatatttattacttagattgcagttactggtcagcttgtataatactgaccaagggttttgattcttcctggaattgataggaaattcatattaaaataattacccaagtccaaacatttttagaactgcatttttgatcatggatttttatgtctcttctgaactttctgtcaccggtataatttaaagaaattatacttaagctttgtctcacttagaagataatatagaacagtggtgtttttttaattaaaaaaaaggttaaaataacggttttgtatccttgctttacttcttaaacatatgggaggaaaaaaaatctttaacaagtttatttattttcattttctgctaaattactttcagaacttgaatctactaatcccagatataatattcttggattcatattccaaattttgctgtctcaaatccatctagggaagtgggtgggctataaattataaataaattccaaattttgtgggatgaattaccctgaagaccaacgtgtaaattacatattaatctttctttttctccctagctcggttttaagaataatgttttagccaacatatctgcattactcttggctcaatatgagaaatccatttttggtttgcctaacagaagatcatcttgctttgcttctctacacagtatgaaaacccaaagaaaagaaaaacagaggcagttttttgctctaatgaatgctctaaatctagctcttaattatgattttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaaaaatatttctgaaatagatcatacactctcttcccaaaaacatcaaagtatgaccgtaaagggcagaggtaggtaaacttcttgtaaggggccagagagtgaatatttgagaattttcagactattaagatctctgttgcaactgcttgcttttgccgtggtagcctgaaagcagccatagatagtatggaaatggatgatcatggcagtgttgcaataaaactttacaaaacagacaatgggccagattggccaggggccatagtatgctacccctgggcaacaacctgtatgccctggagtagtgtaaagaacgtgggtgttgggggtcaactgacgcttccagctctaccacttactggctgtgtggctttgggcaaactactgaaaatctctcagcgtcactttccaagtgtgtgtaatgtgtattttcacagtgctttgcaggttgttgattattgaaaatagccataatgcatgaaattaccagacacatctcactttatggagcctggggctattggtaatatgcatttctttctcatcttgatcgtaaaatgatcttagaaaggtttctgagaatatatagagtttaagacagcaataagacaactaattaattaaacaggaaaaggggatgttgtgctcagagaggaagtgtgggtctcataagggctttcacaatcgtttgagaggacacgtgtgatgtctcatgcctgttatcccagcactttgggaggccaaggcaggcaggttgcttgagttccggagtttgagaccagcctcggtaatttggcaaaaccttgtctctacaaaaattacagaaattagttgggtgtggtggtgcacacctgtagtcccagctgcttgggaggctgacgagtaaggatcacttgagccagcatggtggaggctgccatgatcatgctactgcactccagcctgggcaacagagccagaacctgtcttgtaaagaaaaggaaaaagagagagaagggcagaaagaaagaagggaaggaagaaaggaaaattgggcccaggaatgatctttacaatgcctgacaaccaagagaagaagggaaatgagcttcacattgcctgcaagctctagggtgacaagagccaagagaaattattgttactgtagtgatgttccactgaggatcataaagtactttattactctactgagtatggttttttgttttgttttttctttttctttttctttttcttttttgctattcttttgttattcttgatttatgctgatggaaagccatggacccaaggatgcttcacagttttctttcggagtaaatgcttagattccattttctttgacatgactatgtctgttcctcttgattttaggcatctttttcagatgagttgccataaaagcagcctgctctggataagtgaggtacagcaggacacactgcaaatactaggaatccttaagtacagtggaaccccagagcactctacctgctttctttctcacctccttaaaaactttttttgccctcacctcatcatttattcagcagtcacaacagtgccaagaacttggctagagattggaaataaagcttatgccttctctcatatctcctgtaccttatttctttcttacagtagttgtgatgcttagcagttttttgataactttttatgatgccaaccttcaaaaacctgcccctggtggagagaataattattacatcaattaggggtcacttagcatgacatttgtcggaaaaaaaaaagttagtgagcctttttgccatattaaaagtcatcactgccaagacataaatgaaaatgtgttcgaattaaccacaccaatgttcacaaaataaacatttttgatttcccaacagaatcctaggtttaactatcactatcatctttcatgaaatcaaagtcatatatgtaaattgaacacaactttcccttccatagagagtaaaaaccacgctttggagggtagatacaattaccccagggttgtcttttcccactcctcacaatcccaccagtgcacatgcaaggtgatgtccttcctttagctatagcaaataatgttaattattgttggtgttaaataatgattatgtaaagcactagactagacattcgtcggcaaagtttttctgcaaagaatcagatagtaaatatttttgctctcatcagccagacagtctctgcggcaaccattcaagcattgttgaatacattgttgagtgttacatgagactattgtaatataaaagtagcctgggacaacacataaataactgggtgtggctgtgtcctaataaaactttatttacaaagaacaggaagtggcttggatttggtatctggcctggcagctgtggtttactactccttggacggtggcccagagaccctttaaatgaaattcattttactagcaccctttttcatcatgagaaatatattctgtttttcttagaaaatgggttatgttaggtctggtcaaggtaaataagtgttgagagtcgatgttgtgtgcatagttaatttcaattctttgaagaaactcccccatgatatttcacggctgagagaagaggaaagagtttaagtggaacagtgtgctttgctgagctttggaaatattaccatatagggaagcaggtcaataagacaactaagtgctgtttcaataacgaagatactgaagcgctaattggagtatggaaccatataatgatgataataattgctaatatttatcagctatttatcatgtgtcatgtacagctaagcacttacataccatcccattttatccttataatgactctaagagtgggttaaaaaatggcagaagaatggcagtgtttaatggttcagcctggtgcaatgattaaccacattttacagactaagaaattaagaacctcaaccaagttcatgctagctggtacgcagtaaggctagaacttcgtccaaaatctcttcttctgttgagctcagcttgcatagtagcttggagaatcagaaagatctgtctcatttgggaaatataccatgtaaaaaacattgtttctaaaggagatttgtcccatgagtaaaatagatgatggacagccactgcctagtgggacaattagaaaggtcagttcaaggttggaggagatgcttctttcagccaattttcctttttctcaggatcacctcaggtgatccgcccacctcaacctcccaaactgctgggattataggcgtgagccaccgctcctggcctttcagccaattttctatcaccaaagggaaatcgttttgctggaatatgtgtaaaggaggttaaagtcagaagagattctcgtccgctcagttaaggtactcagactattttccaaccaatcaagagggtgctgcttcatggagttcgtttaagctgaagcggcagctgttgactgtcatttgcatcatctttatacatttactgtgaatgtcactgtccatttccactttctttctacttgtcttcaaattgatgcttatcaagtagacagaagaagaccaaggggtcgttttgctatttatacctccaaattgatggcgtgatcactctcaagtgcaaacccagccctgacactgtcctgtttggcaatgtcctgctatctgacctgcaaatagctacacttcctgctgtggcccacccaggcctctgggatctgatcccttctcccatgtcacctgtggccatgtcttccccaacccaggcttctctgctccgctgcttatgttctggatcctgactctgagcctttgcttgtgtggctcctctcccacttgtccatcatcatgtcagttatgtaagcatagattccaaagtgacaatgagggtagttaggatggcaagaggagaaaaaccaagctggattcatggattgcttgtgtcacgtcctctacagagcctcccttctacctgctcttacccgggcaccacagttgatgagttattttttggaccatcagcaacacacccaatcattgtacatggaatacttcggggatgcttttttctatattgattttacttcattaaactgagctccagaggagcagaaactttggctaatacatcttggtcttagcttgtaatatctgtgctacaacttattaagatggtgacgctggcaaattccttaatctttctaattcttaatttcatcagcaaagatgggaaaggatactaacaccactctgggttgttgagaggattcaataactgaatatttataaagcgtagtacctgatacttaataaaaaagtgaattttaacctgtgtcatcattgtcatcgtctttatcatcctttgcaattattacatttactgccttctagtacaaggaaggggatgggtggctggctggctaggtggatagaaggatggaagaggtaagtacaaggaaggggatgagtggctggctggctagatggatagaaagatggaacaggtaagtataaggaaggggataggtggctggctggctagatggatggaaggggtggaaggggatgcaagaggtaagtacaaggaaggggatgggtggctggctggctagatggatagaaggttggaagacaggaaggatggaacggaagaagagggaagaacaaaaatggaaacacatagtactgttaggtgaactgaacttctaaggtgccgattctcagtgatagaatcttgagttgatacctccttgggtggcatggagcctatacctttgtagatcttgggaaacaacttctaaagtaatcatagttgtatgtaatcgtagttacaacaatagttattttaggcacataacccaaaggttttcttacaaggaatctatgaaccttaagagtgagggcttctgttaagagtaagggcttccctggagtggacatggatcatgggactgagccagcttggcattgttgggttgaacagggagcgacacctctcagcccagtctatcaagcctgctctttgacctgcagtgagaccacccacgcagacatcaatgcagcaaatccccggcgtcagggtttcaacatttggttactctcagagaactctcgatttatataagacttggaaaaagggtttgagtttctgtggtttacaattatatttcccaacttggcccatgaatccagcttggtttttctcctcttagcatcctaaccaccctcattgtcactttggaatctacacttacataattgacatgttgagaagctgtgctaaaaccacactgaaatcacattttaataacatgggaaccatcttttcccagtaaattgttgagaagctaattcttgtcagcctaaaaacttgaatatacatttgaataaatcagcggtgctacaccgtggcagcctgctgaaaatccccaaggaagattatatttttagttgagctacttgtcactgcactgtgtttttaatattgtgagtcctttcttgtcttcatttttgaagaatctattgcataccttgtcattcagaaaaacataaacgggacctctcaattagcggtaaagttcgtcagtttaacttttaagcttaaactcctgttatagttcggtcacttactcgtcatcaaaaagatatttgagctgatattatgcaataatttataaccaaaaacaggaggaaaaggtctctgtttgtctcagaagtacaagttatgcataaggtgacaaattacacagctttgggaaatgggtcttaatggaatgcaccaggctaatagaaaagcagtgcctcgatttcccacctcagatctgaaaactcctgagagactgacagggcggttccccagcttggctgtgtgaggaatcagctgggaatcgaacactgcagtctggctgtcacccccaggattctaatgtaattgttctgcattgtggatcgatggatggatggatgaatggctggacagaaggaagacttggaaaaaatctttgagtttctgtggtttacaattttatttcccaacttggcccatgaatccagcttggtttttctcctcttaccatcctaaggagggagggagggaggaaaagggggaaggaagcaggtagaaagggaacagggaagggaggactggaggaaggaaagcagggatcattctggagtgtacactgggcatttgattttaaagcaaatccaagagatcattaaatttgtatcaatgaatacactgttacccctcaatcaacactacaattcatatatcagaatagcactttgttacttgtttctgagatagggctggctctgtcacccagactggtgtgcagtggcacgatcacagctcactatggcctcagccaccagggttcaagtgatccttccactcagcctcctgagtagttgggactacatgcctgcaccatcatgcctggctaatttttatttttgtagagacgaggtctccttgtgttgtccaggctggtctcaaacttctggaatcaagtgatcctcctgcccctgcctcccaaaatactgggattacaggcatgagccatgtccagctgccttgtttttttctttgaagagaatgatagaccttccataggaaaaatgttaaatatgtgtgtgcagaaataaagatttcaaatatttttgcaagatattttttctaataccacttttttctacattttccataatttagtgaagatagtaaattaacaaagtggaaaagactgaatattttaagaaaagccaagtttaaaaattttgaacctaatatttcttaaagtagctaaaattcagatattgagaataaattcaacttgacatggcaaaattctaataggctgaaataatgttttggtctagaactatgtagctttgtgtagcccatcaattgtctaaaaaaagagtaacctattttgatgaaactcgctgtatcttgtaacctgtatcctgtcttggtattgtgggagtatatatgatttaggggaaagagtctggagagaccttaagtctgctttagggaaagggtgaggaaccccactgaaggctacttaacgcattttgagaatgtcagtaaagatttctcagagcccagggattttttttttaattgagacataatttacatacaatacaattccttttttcttttttttgagacggagtcttgctctgtcgcccaggctggagtgtgatggtgtgatcttggctcactgcaacctctgcctcctgggttcaagtgattctcctgcctcagcctactgagtagctgggattacaggtgtgcgccaccacgcttggctaatttttgtatttttagtagacacggggtttcaccatgttggttaagctggtctcaaactcctgacctctagatccgcctgcctctgtaatcccaaagtgctgggattacaggcgtgagcccctatgcccagccaaaattcattattttaagctgtacaattgagtgatttttattacgttcacaaagttacgttaccattaccacttttgaattgcagaacaatttcatcactccaaaaagaaatctcataacaattagcagttattttccatcgctacttcctccagtcccaaggcaatcagcagtctgctttctatctctacctgtttgcctattctggacatttcatatgagtggagttagataatacatggccttttgtgactggctttcacttagcataatgttctagaggttcatttatgttattgcaaaaatcagtacttcatttctttttatggctgaaaaaaattccattatgtagatgtgccatatttgtttatctggttgtcagtcggatatttctgttgttcctactttttggctactgtaaaagatgctgctatgaacattattgtgattattataccttatttgtaaacatcatgggtggggggttgcagtaaacatgttggaaagtagggttggaggtccgtagaaattgggggcttcagcacttcccccaagctcaacaccaaccccctttctgagcccctcttgaaggagagttccctgggacgtgcctggtattggtacaatcagtcaggaagcatttttcctggggagaaacttacaagtccacgatcaaagccaacaagagacaaggtgttacatgactcattttcggtttaagaagtgacaggctgattctaagttgggttcaattattttgttaaagcgttttgcttatttgacttctcctgacctcggaaataattctaaccaatcagtgctggctcccattggccctggggtctggttgctttacagctggtgacagggggaccactccactaccacatgtgaattaatcctcaactccagagccaagtgccattctccagcaaggttgtatttcttcattagctattcccagggcccagaaagtcccagaggatgtcagagtacattaatttttatcataacatggaatctttcaggtctgaatggcagcacacggctgtcaggggcttctgaactctattacagctccatatatctctaggcaaaacagaggaaagagtcgtcattggcaagggagatgtacaaaatgcatgagatgttttattttttgagtgacttgaccacgtgcttaagcacattccccaaacaatttttttcttattgtttgtaagttgtaagttgtaaattcacctctgccaccacctattaaagcccactccctgcattaaaactgtataaagtgtatttaaataaactctctttgcatgatgtgaatgaaatcgtcatctggtacttaaaactattctataaagttattaaaaaattaatgttcccttcccatgatttttctgcagaatttatgcatccatgatactgcagaagttcataaataatggcttgtattgctgctttagtattgctttatgcctacgaaatataatgttaatttgtagcaatgctaatgtgttttcaggaaggctctttgtttattgcctttattttccccacttaccaagtgggtaaaatgctttgagggttgcattttatgtattcaggaggcccaggtattattttaatagaagcactattgacaaataccagtcatcccccctgtgccaggccctggatgaggcactgcttcgcatgggggctccccagattgtcccacaaggaaagcatagtcaaagacaaagttttcagttgtaagagtaaatgtgttctgcctaggcattgtcaagtaatttactgccagctctagcccttcactcaagtttcctggatacttttgacttcttagccatggatgtgtttgaaggctgcatggaccttcacttacttgcactgcaggtcagcctaattgcatgagctctgtggaccacagagcagggttttccaaagttcaccaagacaaatattgtattatcttaacatatattcattttttaaaactgaaaatcagaagagcaactccacctagcagaagtcttttgcaaagggcgaggcgaggctaaaaagtatagaagagttcgtttccagtgcaattttataaacacagatggtccttaaattaagcaaatggtacctaaatgactgtgttgtggataatggtaacagagggagggactcgggggttttttaaaaagtactgattgtatgcagtgttttaaacagataactgtgatcttagtgtgatgaaagatgctgggagatttcaccagtggtatcttattatttttcggggattttgtaattcaacaaaattctgttgtatgccaagcataaccctaggtgtgagagcacaaggtgacttcagataccacctctatccttcaggggtttggggcccattattatgacttaatccattttgggcgtgagaagctgagggtcacagaaagaaccaattccctctttaaataatgccaccccaaccctcctcatctgccaggtctttcccttcttctatttgtatgaataatagtcactttctcttgtggagttcgctaaattctactttggcctatcaaatttctttcatatcacaactaaatttcttaaggacgggactatggttcatttgtcagacgaacaaatgggaatttgccaagagacacttgggttaatttacgtcttttccatccaagggcactatgttgaagtgaggctagtaggtcatgagtgtggttgaagttactttttcttactttcccgaccagcccccatccttactgcacttaaagttgattgtccattttattaaatgtccccaggaagccagaacacagggcagtaaagtgctgaatgcaaagggcaggagaaaaatggaaacaaccagaactgtaacaccaaggaatgagacctgcatgtcagatatcatgcccattgcactaagtgccattggggcacaattatcaaatggatgcattttccctagaaaaccatcttggagagcatgtggatgtacttctattttacatttccccctatttacaatcaatgagattgagattttgttgctgggactgctgatgatgggatgggaaaatataatcaaggtaatggacatgaggcaaaaatttaaggaaatgacaaaaacaagagtatttccattttcagttaagtgtatgtactgatgttctggaattcactataagaagttgcaaatggtgcatgaaatgaaaaattcctggtggtctccaggggacacagccggtgctgtgctccactctgggtaactgttttggattattttctctattccaactgaaataaaaaaaaattaattaaatgtggctaggttatcttgacagcagaatccattcccagttaattattattttaatacttgatggtgtctgtcaaattgtcgacatgtgacggtcctttcaaatttaaaggaatagctgatggtcactggccacccaagctgatactgattttatatgttgatgtttctcattttatttgctctttccttgaatatttattcaggacattctctaccagacatattgagtaagggcaacagaaacaatacataagtatcttataaatgtggaaaacaatgtatatgtgttttttatctctcaatgattggtgggtaccatatccccaaagtagaatgagcatttgagaaaacaggaaatatcctcttttaggcaccatctctgtcaaggctgatgctgggctttttatatattttctctaattcttgtggctgtcaaacaaggtgggcattatcattccctttataggggacacagctgtggctcagaggggtttattcactttcctgagggccacacacataatgagaggcagacacaggtgacgaagtgagttttccctgtcacgccatcttatctgtcacatacctctctgacatgctaaaattgcactaaacaaaagaattctcttatgcacatatcatgcaaaagatattctttaactggggatcatgtttctcattccatcaatagaatgactaacattttctgagggtgtctcacgtgaaagtaaatcgctcatgtttgttctttttaaaagatgcccttcgtattgtgtatcttgcagtcttgctttctcaaacttaagccaactatatcgtcatttttgcaaaatcactgcgtcagtttactattatttaatgtttattgctaccaattttaagaaatcctttataggactatttgtgaaattgattttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattcccctgccttagcctcctgagtagctgggactacaggcatgtgctaccacacccagctaattttttgtattttagtagagatggtttcaccatgttggcgaggatggtctcagtctcctgacctcgtgatccgcctgccttggccttccaaagtgctgggatatacattttttttttttttttgagagatggagtgtcactctgttgccgaggctggagtgtagtggcgcaatctcggctcactgcaacctcctcctccggggttcaagcgattctcctgcctcagcctccccagtagctgggattacagtcgtgtgccaccacgcctggttagtttttgtatttttagtagagatgggtttcactgtgttggctaaggtggtctcaaactcatgacctcaagtgatccgcccgcttcagcctcccaaagtgctgggattacaggcgtcagccactgtgcccggccggatagaaataatttttataaactccttggatgctacctaaaatcatcttgttttgctagtggcacatgctgcattttgggcagctgtggccttggtggattgctgaagtagatttgaccttacctggactgaggcagctgttgaagggaattgctgtgttcagtgtatactgccatccatgatttcatgaaaccagctctagctatttaagcaggggtcaaacttagaattctacattatttttttcccttttctgggaggaaagacagttgaacaccagcaaagactaagaagtttcttagaagactgtgggtccttgggccctttctattgaatttcagagtatttccaaatactatgaagtcttgcagcttagttgagaaatgccccagatggtgtgacattctgcttccaggagggattggaaagtatttccttttacataacattccactcagctcattcctttgctgtgtctgaaattgaatcccccaaagccacaattatcttaacattcagaagagtgtttatttaatctgcaaaatcttgcctcacttttggggagcatgttaacaatttcacttacaaatcttctgtgtaactcaaccccatggtggtgtctactgctgctcctagactctttaaagcacctttctcatctcaggtttgaaatgatatgtctcattcttgggttccttgagtcgtaatgggtttgtcttgtctccacagcataaatgactctttcttgatcaactagaaccacatcaacttcttccctccagcttcagtgatatattgtgaaacatggctattcaacgtcctgtagaccaaatgccataagaaaaatagcattgattcaaacgtatccatccagatacctaaaaaagttttacttcttaccacatcttgagtctgggcaaacacgcacttcctatggacattgattactgtctactgtagagataacatttgcacatacagattatggcacatggtagaaagtgttaagtaatgtaggaatggacatatcccaagcaaaattggaagccaagtcccctgtccctgctcaagttggtatgactggtgtatggtgccttaatgggtacttaaagtccaggtgagagtggcaggaggcagccaaatgcctaggtagataggagccggtccctgttgaaaccccacttccaagttgaagacagtttaaagactgaaagccaagctacaagttaaatcctcggaccagattgagaacttgtcttcttacttggtgcactcttctgattgatccccacctttcacctattttacatattcctgcccttccctaactggtttcctatgctgtcatgcccacctttgagtgttgccttcactttaaccttctgtgcatgctcacaaagtaattagcatgtaccctccattctgagttaatataaggccccagacccagccacatggggcaactttactgccttcaggtaggggaaccacccccaccacattccctctccactgagagttttccttttagttaataaattcggctccactcactctccattgtctgcatgcctaattcttcctggttgtgagacaagcagttggacctagctgagctaaggagcagaaagactgtatcacagggaacttgtgtaacagcttgatctcctgtcctacgtagctatctattggtaagaagttgaaggaacttgtgtcattccgttgtgcctgtcgtcttgaccttgtaaaaggtcttgggtaagcatgcaagaagttttgaagagggagatacagctaatttgcagataaagagcaagggaagaattcctggagaaaggaagagtttcctgagtcacctttgggaggtaggaagggtttgacatgtaggctgggcatctgggaacgagtgagggattctgtgagccccatctcagtggaccactcaaggaaggtgggtaagccctgggtataagtgtgtaagcagggaacagaaagtactgtgatttaaaatatgttaatttttctactgtacagatgagagccagcttggagatgggctgtagctcaagcatcttacctacctctgatttcttaatgccacgttataaggctgctgcttatagctcttgaagtcactccaaaaacagatgagtgagaccctgttgctaaagtcccactgggtgtagattattcacagatgtatacacagtggctcactccaggtaggatgtgatcagtgcttttagaaatacagaaagtcctattggtttaaaaaaaatttttttttgtaatgaattgagttttaaagctagcactgtacaataaaagggtgaatttcactatgaattatgacaaacacagtcatagagctgccatcatcactgtcaagatacagaacagtgccatcaccccccaaatgtcctctgtgccttactgtagtcatacctgctcctgacacctagcccctgggaaccattgatcttttttctgtccctagttgtttgtcttctctgcaatgttacataaacagaaatattctgggtgtcgcttttggagtttggattccttcccatagcataatgcatgcagtatttgtctgtttctgctaaattacccccaagacctagcgacttaaaacagcaaacatacactatctcactctgttagttttccattgctgttgtaataaattaccacaaacttatgtgcttaaaacccaaagctattatctgacagctctgtaggttaaagatttgtcatggttctcattgggctaaaattaaggtgtcggtatggctctgctgctttctagagactccagggagaatatttttccttgccttttccagcttctaaaggtcacccacaacatcttcaaaaccagcactgttgcatctctgaccttagccctgtagtcccatttccctctagccacaatcgggaaaggatctcaggactgttgtgatgacactgtgcttacctagattatctagcatgagctccctgtctcaaggtgatagagtttgcatgtttttctcctgcacatgccatgttgaaacataatccctagtgttggcggtgggtgtgctgggaggtatttggatcatgggggtggaaccctcatgcatgacttacggccatccctttggtgataagtgagttcacatgatatctggcaccttccttcctctgttgctcttgccctcaccatgttagctgcctactccccttttgccttccgccatgactgtaagcctcctgaggcctcaccggaagccaagcacatgcttcttgtagagtctgcagaatcggagccaattaaatctcttttcattataaattatccagcctcagttacttctttattgcagtgcaagaatagcttaacacacaaggtcttacccttgatcacggtctgcagcatgtcttttaccatgtaaggtaatatgttcagtggctgtgggggttaggatgtggacttctttgggggacttttatttttcccagttactatttttgtgactcaggaatttagggacagtttggctggttgtttctggctcagggtctttcttgggctgcaatcaagatgtcagctgggggctgggcatggtggctcactcctgttatcacagcactttgggaggtcgaggtgagtggaccatttgaggttaggagtttgagaccaacctggccaacatggtgaaacgccatactaaaagtacaaaaattagttgggcatggtggcacatgcatgtaatcccagttagttggggggctaaggctggagaacagcttcaaaacaggaggcggaggttgtggtcaactgagatcacaccactgcactccagcctgggtgaaagagcaaggccccacctcaaaaaaaaaaaaaaaaaaaaaaagttagctggggccaaggtcatctcaagtcttgactatgaaaggacctaacatcatgcatggctgttggcagaggtcacttcctcatgagcattaaactgaaagctataattcctgactattgaccagaggcgaacctcagttccctgccatgtgggcctcttcatggggcagttgataacacagcagttagcttccattggattgagtaagcaagagagcaagaacaggagtgatacagaagccagcatctttttgtaaaccaatctcagaagaattgtccatgattttttctatattctgttagttagaaacaaattcctaggtctcacccacccttgaggtgaggggattacacaaaagtatgaaaaccaggaagcagggagcattgggagtcatttggaccctgcctaggacagtgcgtttgagatccatgttattctatccattagtagtagtttgcttctttttaatgttgagtaatatgccattgtgtgtttatatattgctaatggattttaaagagggctaatcaacgtgttgattagagggaaattttcttcagtgaaataatatttgagcaaaaccttgaagaacaattaggaatttgacagagggaatggcacgaataaagacccagacttaatcaagtgaggggcgtactcatccatggggcagtggatgattcacctgcctggagcttaaggagaagggggtgtagttgtggctgttgctcagaaggacctgaatgtcaggatgcatttgtgtttaatttagcagacatttaggaaccattaaaagtttttgagaatgggtaggtaagattagaatagtattttaataagtttaactaggctttaaccagtattcataaaaagtcaagtgggagaatgtagaggtgacaagaccaggtgtgggctattgcagtgactacacctaaaaggaacagagctagaaacatggagtgacatgaagtcattgtcttaggttggtgatcctagcagctgagcctgggatggggattcttgttcctatgatcgattaggggactgttcccagaggagagcggagagggaagcaggctttggtttctactggaaatctgtttccgcccgattccatggggagctctggagaaggaattgtatcaccgagttggtcctccttgtcaacagagcatgtgtgtgggggtgatgacttcccagatgtgagggtgccctccagcaatggacagttatctggaggagttcatgctccagaggtagtgcctacctctgtggagaagtaggggatggcacggtattttaggggttcctaatgagcctagagatactgacattgaccagtcatggagactaaaggagaagatgggatagcacattgttttcctaagtatttgtaatcaggtgactggtttgcaaatatcagccattacagaaataaagggtatcaggacggggaggagatgtgaggagagaagatgaagagtttagatttaggcatgttgaccctgaatttgtgggaaggtatccaggaagataagactgacaggtgggaatgagattctggaacttggaaagaatatagtggctagagctaagggtttgaagtcttcatggcgattttgttcggagtcatggatttggaagaaactgctgcagggaagattttagagatggaatgaaaagagattggtgatggaacaatgggcaaaagaggaagggttggaggagacaaaaaatggagtggtagtggcattgggaggtccaagagtggatggtatcacagaagccaagacaggaaagtgagccagaagtgagggaggagcaggatcctctgcaacagggcagtctagtcttagcagagaggaggttgctgaatttattgattgagaagccactcctcgccaggcagttttgagaggttctggatggtgatagaatggaattcattcagctgatgatgagaagtagatttgggtcagggaaggagactgaatggagatgaatatttcaaaactatagaccataaatgggaagagagagacgagtgcaacctgcctaggtcaagtgaatgtccttttttctcttcccagcccttgtcttttttaccctctttgttttctgcatttctttccttctgttctgatttttccttacctgatggtcagaaagatctgattgagctgacgcgtagcaagaatgagccagtggagaggaaaatgtaaccacctaatgggttctcctttcctgctagctggacagagctgatttatcaagacgggggtactgcaaatagagaaagaatttaatccacacagagccagctgtatgggaaaccagagttgtactactcaaatcaatctccccgagaattcagggatcggagtctttaaggagaaatgtggtggatagggagccagtgagtgatctgggagtgctgattgtctcacgtgtccatgtgaagagaccaccaaacagggtttgtgtgaacaacaaggctgtttatttcacctgggtgcaggtgggctgagtctgaaaaaggagtcagcaaagggtgatgggattgtcattagttcttagaggttttggcataggcggtagagttaggagcaatgtttttggggcagcgggtggatctcacaaagtacattctcaagggtggggagaattacaaagaaccttcttaaaggtggtggagattacaaagtacgttgatcagttaggtagggacagaagcaaatcacaatgggggaatgtcatcagttaaggctattttcacttcttttgtggatcttcagttgcttcaggccatctggatgcatacgagcaggtcactggggatatgatggcttagcctgggctcagaggcctgacactgatttgttggcttgaagatgaaatcacagggaatcaaaggtgccctcctgtgctgactcagttcctgggtgggggccaaaggactggttggcaggtctgcatggggccaccgtgttgtcagaaatgcaaaaatctggctggtgcaatggcttacccctgtaatcccagtactttgggaggctgaggttgtcaggcctctgagcccaagctgagccgtcataacccctgtgacctgcacatatacatccagatggcctgaagcaactgaagaactacaaaagaagtgaaatagccagttcttgccttaactgatgacattccatcagtgtgatttgttcctgccccaccctaactgatcagttgaccttgtgacattcctcttcctgaggcagtgagtctcaggagctcccccaccgagcaccttgtgacccccgcccctgcctgcaagacaaaaccccctttaactgtaattttccactacccacccaaatcctgtaaaactgccctacacctatttccctttgctgacccctttttcaaactccgtctgcctgcactcaggtgattaaaaagctttattgctcacacaaagcctgtttggtggtctcttcacatggacacgtgtaacagaggtgggcagatcacttgaggtcaggagttcaagaccagcctggccaacgtggtgaaaccctgcatctactaaaaatacaaaaattagctgggcatggtgctgtgcacctgtaatcccagctactcaggaggttgaggcacgaggatcacttaaacccaggaggaggagattgcagtgagccaattgcgccactgcactccagcctgcaatgcagagtgaaactgtcttaaaacaaacaaacaaacaaaaagcaaaaatctgaaaagacatctcaaaagccaatcttaggttctacaacagtgatgttatctgcatgaataattgagaaagttgcaaatcttgtgacctgaggaataacggctggtaattatttaaaactcaagcccctctcatcctaacgtggtggcctttcattcattttacaggaacagtttagttttgggggaaagctgttatttaaactataaacgaaatttctcccaaagttagcttggcccatgcccaggaatgaccaaagacagctaaccagttaccggaaacgggtcccaatctagaccccaagagagagttgttggatcttgggcaagaaagaatttggggtgagtctataaaattaaagtaactttataaagaaagtaaaagaataaaagaatggctactccataggcagagcagcaactttggctgttggactaaggatatttatagttaattattgattagctataatatattttaatataatatatataattataatacaatattatatataatatatattttatgtaactataaacaaggggtagattactcatgagttttcacggaaaggggtaggcagttcccggaagtgagggttcttcccctttttagaccatatagggtaacttcttgatgttgccatggcatgtgtacactgtcatggtgctggtgggagtgtctcttagcgtgctaatggattcatattagggtataatgagtagtaaggatgaccaaatgtcgttgccatctttgttttggtgggttttggccggcttctttactgcaacctattttatcagcaaggtctttatgacctgtatcttgtgctgacctcctatgttatcctgtaacttagaatgcctgacctcgtgggaatgcagcccagtaggtctcaatcttattttacccagcccctattcaaaatggagtcactctggtttgaatgcttctgacaaacctctgagactaaggacaagatggagtctgttaggttagttttaatttcctcagttattatttcacaaagggggtttcagaaagatagaaaatgctagaaagagacggggtagtcagtggtagggatcttgaggggttaaaaaagggaaggagctggtccctttgcagtaggaagtgccacctcactccactcttgccagaaagcctggctctgtcataaggaatcttggcccattgtcactctcattgatgacaacccccgcccccaccactaccaccttaactactgaggggatgtcctctggcccagaaggaatgcattggctctagttgaaggggttgctggtttgtaaatagcatccccacagtcagcagacacagagaatgccatggggccactcatcagaaaggtggaggggctttatctgtgggtagatgagagccatgtagaacctgcatgctgccttccattggaatctcaggctctaaacaaggaggacaaccttttctgcccttaatcacctctcacagatgagaatccacccaagaagaagaaaaaaaatcagccccttaaaatgctgactagtaacatcagtttttggaaggatactatttttgtttccattctgtctttatagtttgaacttttccttttcatagtctgtaaatattcatcatctcagagccttttgaattgcaatggcttttagtcaaaactgagcgcaatgtgccatttgaataataagaacctcattaaagtgaggcaaaagtaattcttttccttttgtacaagccaattaagtgtctttacaattaaaacaaagtcaagcactttatagtttcatattccacaagcctgtttttaattaatagaggtgacaagttttaggtacaggatacatattttgcctctggagttgtgcaattaacattaatgaagggtattaaaatttggtgagagaggaaagggttttcccaggtcctctgtgggttcttgcctccaggcctgtctttggtagcaagttccttggtttgctgaggtttgcattttcttgagagaatgtacaggcaagaataaaagtaactagaagagacattgttgttattgagaagtatgaagttaaaattcccaatgtccaggcctgtcttaaaattaggtaaacactgcagaaactatctttgaggaatttaattttgtcttgtggataaaagtgaaggataaagaggagaaataacaattatctaagctggcaggccagcaagatactggggctttacttctcacaaccatgggaggagtatatttagtttacaggggaggacacagattcacaggggtgaactaactggccatgagtcaggtaaggaaaataacatggctgagctacagtttctctaagaagttggttctgtccatttcagggagcttatgtaagacagaaggtattgtgcagtagccttgaagtcaggtgaccctttgggggtgtgtgtgtgtttgcttctttatattagcttttttttcattttgagacagggtgttgctcttcctcagttgcccaggctggagatcagtggggtgattacagctcactgcagccacaacctcccaggttcaagagatcctcccacctcagcttcccaagtagctgagactacaggtgcatgccactggctatttttatttttttctttttagttttgagtttttaattttttgtagagatgaggtcttgctatgttgtccaggttggtcttgaacccctgagtccaaaagatgctgctgtcttggcctcccactgtgctgagattacaggcatgagccaccatatctggcctatgttagctatttctgaaacttcatttctgtctgtaaatggcaatcataatatatgtcacgtagggttcttaaatacaaaaagctcttaaaaagtgcctaacccatagttagtactcaaaaaaggaaaaaaaagtattaatagccctggaaaagtgagcaaaatatttcagatgcaacctgaaaggagttcaaatgtaagtctctcttcactttgcccatctttccctcttccccgcaaggtttttagcagtggtcctgtcttactacaatatatgaattatccctgctacaaattagtagattctgctttgatttgaagcagagtctaatgagtgttacaggtaggctcggtgcttcaaaggatttctgcctatctcttcacagagtagctgggctattgagggactgtgtattgacaattgtagtgggcaccctatgtggaaaacaggtgttgtcaaataactgcaactgaccccaaccacaccatgacttttcaggttttaggtaggggatgggtgggaaaacagatgaggcaacagaatgaattattccttaataagatccagattaccgagtgataataagatttgcatgaatacttcaaacaacaacagtgattaaatacgtttttctagttaaaaaattaatgagtgctttccagcaagcgcttaaagaattaatactggccgggaacggtggctcacgcctgtaatcccaacactttgggaggctgaggtgggtggatcacgaggtcaggaggtcaagaccatcctggctaacatggtgaaaccccgtctctactaaaaatacaaaaacaagattagtggggcgtggtggcgggcacctgtaggcccagctacttgggaggctgaggcaggagaatggcgtgaacccgggaggtggagcttgcagtgagccgagattgcaccactgcactccagcctgggcaggagacagagtaagactccatctcagaaaaaaaaaaaaagaattaatatcaattttccacaaactcttttaaaaaaacagaagaggaggaaacactttccatctgacactgtgaagccactattactctgacaacagaggcagacaaagatatcacaagaaaaggaaactttaggtcactttcacttataaatagagatgcaacaattttgtacaaaatgctagcaagccaaatgcagccacatatacaaagaattgtatattatgactaagtggaatttatccaaacaattcacggttggttttatattaaaaaatcagtcaatataatataacataatagtagaataaaagatcctctcaatacatacataaaaacatgttttaaaaaggtccagcacgctttcttgatgaaaacttttagtaaacttggaacaaagtggcattttctcaactcaataaagggcatctgcaaaaaacccacaaatgacatcataattaatgctgaaagattgagtaccgtccccttaggatcaagaaataagacaaggatattcactctcatcactttaatattctactagaaatcctagctagggaaattgggcaaaaaacaaaaaagcaaaagaatggaaaaaaaagatccagattgaaaagaagtaaaactatctttatttgcaaatgaaatcaccttatctgtagaaaatcctagaaaggtacttaaaaaatattaaaatgaacaggttcagccaggataaaagtaggataaaagtttaatatgcgtaagtcaattgtatttctatatactagcaatgaaggcatcccatgttcatgtatcagaagatttaatattgtatagctgaccaaactctgcaaattgtgtacaaatttagtgcaatctctattaaaatttcagttgacttttttacagaaattgaaaagctgatcctacattttgtatatgaatgcaaaggaacctgaataaccaaaacaagcttgaaaaagaagagtgttggagggcttccatttctcaatttcaaaactttctataaatccttagtaataaagacagtgtcatattggcataagaatagatctatagataataaaatagacttgagagtccagaaatgaatccatgcatattgtgaattgattttcagcaaggatgccaagacaattcaaaatagtcttttcaacagtgatgctagaaccactggatagccccatgcaaaagaatgagattagatcacacttgcataaactacacagcaaaaaatagcaaaaaaaaaaaaaaaaaaaaaaaaagggtcagagacttaaatgtaagagctaaaactatacaactcttagaagcaaacataggggtatatttttctgattttggcttagacaatgatttcttggatacaaccctgacagcacaagtgacaaaagaaaaaaagatatccagaatgatccagaatgaaaagtgtttgtgctgcaaatgataccatcacgaaagtgtacagatgacctacagaatgggggaaatacttacaaattaaatattaaataagggatttgtatctagaataaagaacttttacaattcaataatgaaaactcatttaaaaaatgagcataagatctaaatagatattcctccaaatatgatacacaaattgccaatgaatacataaaagatgttcaatctcattagggaaatgcaaatgaaagccacaatgagattccacttattgctaggatggctaaaataaaaaagtcagataacaaatacttacaaacacatggagagatgaaagttcaaatacagtcctggcggaaatgtaaaattgtatggccaaactggaaaacagtttggccattattcaaaaagttaaacattgaattaccatatgacccaataatcccactcctagatgtatcttgaagagaaatgaaaacatgcatttccatagcatcttacaaatgaatgtacatagtagtgatattcctaatagccaataaatggaaacaatccaaatatccatcattggtgaatggataaacaaagcgtggtatattcatataatggaatattatttgcccattaaaaagaaatggattactgatatatgctacaacatggatgaaccctgcaaacatcatgccaagggacagaagccagtcacaaaagactacgtattgtatggttccatttagtatataaaatgtccggaataggcgaatctataggacagaaagtacactgatggtgttttgggaataagagtgtaggtagatagagggtggctagtgattgctaatttttttttttttttttgagttaaaaaagtgctataaaattagaatgtagttatggttgtacaattatttgagtatactaaaacagctgtacagtatacataggtagattttatggtatgtgcattatatttcagtaaagttctttaataaattagctaatgcttattgtagaaaagttggaaaataccaaaaaccataaacaggaaataggaaaaaaagtaatcctgactgtatatctggaaatcttttcgtggggtatggggtatgaatcacacatattaattttaatttcctgctttttcaattaaattgagaaagtttgggaacctctggcttaatcattatttatccacttctctgttgttggatgttagattgcttctagttcatatgtaattttataattttagttgacatgtcattatggattcttgggcataaacgtttatatgaattttgaatattaggaaataatcttggaagctatattagttttctaaagctattataacaaattaccacagatggagtgcctcaaaacaacagaattttactctcttacagtttcagagaccaaacatctgaaatcaagtggtttgcagcgttggctccttctggaggctggaaggagcatctgttccatgcctttctcctagcttcccatgactgccagccacccttggaatttcttggcttttatcttagtcagtctaatctctgcctctgtctttccatctccttctctgtgggtgttccttctccccttctgttttgtaaggataggcctgtcattggatttaaggcccaccttaatccaagatgatctcattttaagatgtgggacttaatcacatttgcgaagaccctttttccaaataaggtcgcattcacagatccctaccattcaactcactatggaagcaatgggatgggaggtaccattcaactcacagattcctaccattcaacccactataaagcagtggcatatgaaaaggatgggaggttgctatgggaatggtctgccccagatgcaggtaaaatggggaagcattttatatagaatggaaaaacaacagtaaagctggctaaaacttgatctgctttttacagtcatgtgctgacaattctaaacattatcaatgataaaatacttctccctcatgatattaactgtgcaatttttgctgcccctgctacatacatgctttattgcttggaaacaggattacttggtgaaataatgtgaatctttcaattctcatgatacatgttttcaacttaatatccagggtgcaggaatatatattcccaccaactttatacaagataatacaaatataatagtatgaataaatatgctaatttgatagaaaatattttaatatttactactagtgtagttggacgtgttaaatattgcaatggttatttgtaatctacctttataaaatttctaatgtctgccactgtttctgttagactcttaagaagatacgtgtttgtctcatagatttgtaagaactctttatatactaaaaatatggggcttctatatgattgcatatattcgtcacttttgttccactgttttagagagcagaagattttaatttctataaagatttttatgtttccctttattgcatgccaatgtttgttttttaaaaacttgtacgtcttaggctgcgatgtgaaaagtgtcttttttttgatttggaaacagagtcttgctctgatgcctgtagtggtatgatcatagctcattgcagcccttgaactcctgggctcaagtaatcctcctatctcagcctccgaagtagctgggactacagccacacaccaccacacctggctcactttcgggtggttgttgttgagatggggtcttgctgtgttgctcaggctggttttgaatactgggctcaagtgattatcctgccttagcctcccaaagtgctggaatttcagaggtgagccactgtgcccagcctcctgttttttttacatgtatatatatatatatatatatacacacacacacacacatatatatatacacacacacatatatatatacacacacatatatatacacatatatacacatatatatacacacatatatatatacacacacacatatatatacacacacatatatatacacacacatatatatatatacatatacacacacacacacacacacacacacacacacacacacacatatattttttttttcttttagatggagtgtctctctgttgcccaggctggggtgcagtgacatgatctctgctcactacaacctctgcctcctgggttcaagtgattctcctgccttagcctcccaagtagctgggattacaggcgtgtgccaccacgctgggctaacttttgtatttttagtagagatgggggtttcaccatgttggtcaggctggtcttgaacttctgacctcgtgatttgcctgcctcagcctcccaaagtgctgagattacaggcgtgagccgccatgcctgcccttatttttatatatcttccataacctttctatctctttctttctctttctctgtttctgtgtgtgtctgtgtctgataataaaatacattaaattttattttataacataaatgttttataaggtcggtagatttgtttatgattttaatggctgcatagtattctatcatatggatatattctaaatgtaataattcctcaatggtatatttagtttactttatatttgctgctttagtttgtcacaaacaccgtggatagccttgtatatatttattttgttgtatagttcttattggtacagtatgatttttcacaagtatacaattactttctgagaatttagctttttgattcacgtgaaagccttacttgtattgttaacaattttgttacgtttgtgaggcctaggcagaaggattgcttgagaccaggaactcaagaccaccttgaccaccttgggcaacatagggggagcccatctctacaaaaataaaaaataagaaataaaatagccatgcatggtggtgtgcccctgtagtcccagttactcgggaggctaaggtggaaggatcgtctgagcctgggagtttgagactgcagtgagttatgaccacaccactgcactccagcctggatgacagagaaagatcttgtcaaaaaaaaaaaaaaaattaaatatatacaaaataagggagaatactatgacaggcttccacttacctatctttaggcttctttataaaatgttcatttaatctgatctctataagaaattctgtatccttaaacaacatgtgcccttctctttacacagagcgattacccccttgctatgttttattaacagctagcaagtgctgggtcctgtgtcagttgttttgttttttctttttctttgtttttcttttcttttcttttcttttttttttttgttttttttttttttggagatagagtcttgctctgttggtcaggctggagtgcagtggcatgatcttagctcactgcaacctctgcctcctgggttcaagtgattctccggcctcagcctcctgagtaactgggattacagacatataccaccacacctggctaattttttttgtgttttgacagagatggggtttcaccatgttggtcaggctggtctcaaactcctgacctaaaatggtccacctgccttggcctcccaaagtgctgggattacaggcgtgagcccccgcgcctggccctgtgtcagcctttttaacagcataatttttcctttattagtcataactactttaagggctattttgatttacagacaaagtgagacttggatgaattaagaaagaattaatcaggtggttgaacctgagttccaactagggtgacaactcttcgcagattgcctgctgctgtcctggttttcacactgaaagttccgtatcctaataagcctctcatcctcagcaacggaggacagttgcccactcaaagccttgtgacattctagggtatcctatttctacatggtgggaatctagaagacggagaaagaatttctcattcccgaaggagcatggattatccttggttgtagtgtttatgtccacatcacgtggattcccgaaggagcatggattatccttggttgtagtgtttatgtccacatcacatgggatattttatttttcaggcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcggtgggtttgaattgcatatttgttcacttatcccctttctcataccagctaatattcccccaaggctctcattctgaaaataattttcattagtcctgcttgagacatgtgggtggactcagcttggctcacttaatttttccaggtcttttttgttcgcctgtgattgtgggggactgtttagaaggactttctagagcaaggaagattgtttttacgactatacttcaagctcctcattgattttgcttagagatggaataataattgatgaaatctgaatggcatgacctttattgatttgtaattcaacaacttcaacatcttaccaagaagaatgtgcagttattctagcaggagaaacaatgcaattagagcctgcgagatgaaatcaaattgttttataatgagaaattagggaattcgaggcagacattagctgtgtaattgtggaaagggaagaactgtagttagagcatattagaaatctggccgtgcctcttttggttaaaatttcaattaaaacatcagatggcacttttttcctattgccattaggagaatattcaattgactgaaaaggacatttgaaaatttcctcgtattttcagcatatttgtttctagagttggagaaacaactatttgtctagagagaagtactctgaaaagacaaaggccttgctgggtgaggctggatttaatacatgttagggagatttctctttcacgtttgcttggtgtgtgtttggcggggggaacttacactcttagcaaagtagctagaaaaaaaaataacgtgcaaggggcctattttttcctccttcttctccgtcttaagtcctgaaatgttttagtgacccagaatgaagcttatttttttaatcatacttccataaaatgtaacccctgggacttggaagagagagaccagccaagggttagcttgaaccctttatcactcccaaacacaggggcttatggtataagtgacacactgcagatagatttacttttgccattttaaatttatgatggctgaaatgaaaggtaaatgccagtaataatcctcccccgtgttaaaagacatgaaacatctagtaattaggtggtaacaaaatctggacagccttatctttgcaaatcacaccaggtttgtgaaggaaagtggagtggccctgttaaggggcgagggaggctactgtgggggcaggcagcagagagagctccagaaataaatctgccagccccagtcatccaccagatgtggagggcaccacgggatatgtttaaatgagctggtatttaatgggagattatgtcgaattgtcagctgctcactctccttgtaaatctgtatctcaaatggtatttcgtgtgacgtctttgttctttgcttaactacggtgtaattcatgcctacttcagagatccaaatctcagcatcatttaaaagattagtttgaaaggaagggacttgggctcttgaattagacctatgttagtttatagggaggccttcctgaaatgtgttgtcaggcttgctcctgtgtgatggctggcactggttttatgctttccaattattctttgcacatcgttatttattattactgttattattatttgacatggagtcttgatctgttaccaggctgcagtgcagtggcatgatctcggctcaccacaacttcagactcccagggttaagcgattctcctgcctcagccttccaagtagctgggaccacaggcgcttgccaccacacctggctaatttttgtatttttagtagagacggggtttcaccatgttggccaggatggtctcgatctcttgaccttgtgatccgcctgccttggcttctcacagtgctgtgattacaggcgtgagccaccacgcccggcctctttgcacattatttaagggtgttttaacaaaatggcaatttccccaggctggcttgtgtattaccttcgcattgcatcccttggctcccatgagtgagcgtggtgacttggtgcgtaggtggtacgtgaagacagttgctcactacccaagaactcagggccctaaaccatgctgtaaaatgcaagtgctgatatctaattacctccatcaaccttggcagaatctcttcgttggagttaagaccccctgttaggggaaaaaagaaagtcctatgtttgcagaaaatattatactagactgctccaaggcaaaatatttattagccttcctgtgtcttcactgtgttttagttacttatctggaatctgagcaactgaattgagtttctgcatacctaaaatacatcatagtgaaatgagaagttgacttctttgctgtgaaaaaatttcagataacaattaaagtagaatgaaaagagcagagtgctggttgaacaaccctcaatggctgcagctgcatggagtgccaaattgccctcccccaccccacacacaaaatcacacatacacgcacgcacgcacacacacacacacggagtttctcagcttctgtgtagacagaatccagcctaattattttaggcgggaattttaaaaatcctcaataaaattgggcttggtagcacatgcctgtaatcctatctagtaagaggctgaggtgggaggatggcttgagcccaggagtttgaggttgcggtaagcgttgatcatgccactgcattccagcctgggtgacagagtgagaccccatctctaaaataaaaattaaaaattgtttaaaaaaaatgcagtataggccaggcacagtgtctcacgcctgtaatcccagcactcaagagttcgagatcagcctagccagcatggcgaaaccccatctctactaaaaatacaaaaattagccaggtgtggtggtgcacgcctgtaatcccagctatttgggaggctgaggcaggagaattgcttgaacttgggaggtggagattgcagtgagtggagattgcaccagtgcactccagcctgggtgacagagcaagaccctgtttcagaaaacaaaaacccaaaaagcaaaacccccacagtatatatagaaatacaagatttgtgaggggcgggggtccccctacaaagcaagtgttactgtccacagagcaaatgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagataagaagctggcccacccttgccacttcctggaggactgtcagtgctagctaatgagactgtaaaagtggactatctgcccaggagacagtgaggaaggaaatcaggggtcacccttacagggaagggctctttgcagagagagtgcctgatacgtagcagctggtacttctccatcttgaaactgtccttcctggttttgtctaatttgtcatcatgggattcttttgacttgtttctagattagggatcaagaagaaatgactttctcctcttagacatttaattcacttagtgttccctagtcatgacatacttctgtgttatccttaaatactgaaacagggaccttattcttaacagtagaaaatcactgtgtatgatgatagtgtatacctgtaataccagctactcaggaagctgaggcaggaggatcccttgagctcaggagttgagattagcatgggcaacaaagcaagaccttgtctctaaaagaataagcagaaaccaaaagccctaaacatgaggaaattccacatgtaaacattaatggaaaacatagaagagttgaacctagtggtaaattttacctttagagcaatgcttgaaacaagggaaactgtcaaattctcatcatgggatttgtgttcctttgttttttttattaaggacttggtccttggattggaattccaaacccatgaccaaactgtaatcatctaattctgtattgagtccttactatgtgtcaggcactgtagtaagcaacactcaagaatcttacagtctactttccaagaattcacagtctagttttggaatcaggtgatcaattgacttacagtctggtatggtgatgacagaggagcaatgtacagatagaacagaaggatggcacagtgagccttttcaccaatcttggaaggccagtaatgtcagtgaacactaggaatggtgtcatggcctgggtcctgaagagtggatacttaatgtccatggaggcatgcatttttatctgccttgcatggcttctttcattctctccctgacttccacccaaaaaatcaccatgatatccagctgtggaagagttcattatggagagcttcctggaagaagtagtccctgaactgggttgggctaaacaaatatgccaagaagggtttctggaagcagttgacaaaagatgagtagagagagggagggggtggtgctatatttattccatacctttcagatactctctaaatccttgtccctgttgtctatgccatgtaggtagagttttcaagtcatgtcccataccttggatcattggattctcaactcagtagcacctttgtgtgacacctcttctgtaataccttattatgttgaaataaagttagcaaataacataacttacatgcacaaatatattttcaattcgatatgatagctttactgtaatgaaagaaaaaataactgaaacaaaatggcgtgtgtttcaacatgtaaatgcttgggccaggctacaggaaagatggggatgtatgtatccgtggatgaatcaccttgaatggactctcataaaaaagcccaccattaccaggtgtgtggtattgcagactccagcaccaccaaccttgagtgaagcctgactatattagtctgttctcatgctgctaagaaagacatacccgagaccgggtaatttataaaggaaacaggtttaatgggctcacagttacacatggctggggaggcctcacaatcatggcggaagatgaaggaagggcaaagggatgtcttacatgacatcaggcaacagagtatgtgcaggggaattctcatttataaaaccatcagatttcgtgagacttattcactaccatgagaacagtatgggagaaagcacccccatgattcacttatctccacctggctctgcccttgacacatgggggttattacaattcagtgtgagatttgggtggggacacagccgaaccgtatcagtcaccctccaaaaatcacacaaaatctgaaagtgcttttattcattctacatgtaaatagttgttgcactacccacctggaaattcagtggatgtttctaggctcagataattatccacaggcttttcatctccatgagtgtccactggggcattcttcattgagcaatacatcatgtgcattgcaagacatctgccatccctgctaccatcaccagcagtcatcacgacaaccagaagaaggccgtcatatattttcaaattgcctgctgagttccattgccttagacaattaagcttggaagtcagactcttcctgtggtttgggtactagaaaaaaggcagccaacaattcgtttcaaggtctcatttctgtatccttgatgacgtttctggccatcagctttgttgatgactttagagcagctatgtcatttaacactagaaattggatgtcaccgagtcctgtggaagggatatttaatttccattaaaacatgaatttcattctgcccttgccatgcttttcttggtcttagcccaacctgagctgctgatattaaggaataataggataattccataattttcattttaccttttgctttttgttttccatagcagttatctagaggattcccattatgcttcttcattacccggtgcccagaatgaacttatagaagcagaatatgaggggtcctttgacaaacatgagactgtttagaaaattccttttgtttgctgtgatccattttgtaagggaagtcactataatgttgttatttaagagaaagagacaaacggaaagaaacaaacagctggtgtttaacgactccgtcagacccaattataaagcatcaactagttacgttgatttgtgtacatccatgccatgggtatacttaaaaacattagattttgccagaactcatcttggctttgtttacatttttcttttaaacgtataagactattgatggtacctcaccaaggttataacccctttataatcattaatttttaatctagaaaagagtcttggagacaacaagactcatctataatttcttggatgctcaaatgaaaatatacaggactcaagcattagctaaaataatccaggaaagccctgtcaaaggttaggaatgtgatatctttctgtttccaaaagcagcagccctttattcaagacacttttctgtttaatttaattatctttgaacttcctgttgaaggttttgaaaaatatatgttagagggtggggagagagttcagtatgtcaggactgctacatttatgagtgtgggtctttattgaagtctctctttgtagccaatcctttttttttttttaatttttaaattttaaattcttacttttagatatgggggtctcactctgttgcccaggctagagttcagtggcacaatcatagctcactgcaacgttgacctcccaggctgaagcgatcctcctgcctcagccccccaagtagctgggaccacaggcatgtgccaaaatactcaactaattgtttattttttgtagacatggtgtctccctatgttgcctaagctggtcttgaactcctacactcaagcaatcctcccgcctcagcttcctaaagtgctgggattagaggcatgagccaccagacatgacctgtgtttatattgttaaatcaccattgtcaatcttgaaaggagactttgttttgatgtatgtaagattgagtttttactcatctctacatagtttcctcagattgcttttttttttttttgagaccgagtctagctctgtcacccaggctggagtgcagtggcacaatctttgctcactgcaacctctgcctcccatgtttcagtgattctcttgcttcagattcccgtgtacaggcatgccaccacacctggctaatttttgtatttttagtagagatggcattttgccatgttggccaggctggtcttgaactcccgacctcaggtgatccactcgtctaagactcccaaagtgctcggattacagatgtgagccactgcacccagcattccttagatttccaataaaaataaaaagctgtgtgggaagtcagaacttggttgcttcatgtcatatttcctatttttaagatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatggtaagagaacagcttctggcgccgcaaacaccttgggtcctagagaaacctgcacacttgtgtctccacctttttacctcttgcgggcatgagtctggtctcagtaataacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaaactgtatcttttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtattttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaactgtctgctgccttctcttacactcattcccacctgccacccttaaccttcgtatttggggatgacttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccaccactatgcccggctaattttttgtatttttagtagagacggggtttcaccgttttagccgggatggtctcaatctcctgacctcgtgatccgcccgcctcggcctcccaaagtgctgggattacaggcgtgagccaccgcgcccggcctggggatgacttttaaaaccacatcaaaagtcttttgaagtgcttaggaggaggtaagtaagtatatcttttattctaatcacccaagtggtttttaggcagagtaaacagacatattccaagagtcgaatacttaggatcagtggcagtgaagtgaaaggacctacggagaatggtgttccatgccgcagggtgggattgatctctaggaagtaaatgaatgaaacttacctgtaggtggatcacagggttttgaaatctccccatcactttgctcccgatgactgcataagcgcagcctcttcatgaaagtttctttgaccatggttatgcctcatactttgttgtgtccttcagtttacatgaaaagaaggaatatggatctgaactgggtgccagtgccatttaaatgaggcatttaggaatggggagaggagagaggtggattcttccttattttctgctggcccagtgccttccgctttaacaagcccagtcaaccatcatttgtaatctttgggtcttgagtcatctcacttgtatttgatcattgatgtgttttaaggagctcggttcagtggcatcagagagttcgttttctccttcttccataaggtccctaatcagaggaacgggatgggaaagctttagagatgagtctgtgactatggaatttggtgaggggtgatataaccatcctgccatttgttgtagactcgaatggatgaggagtcattgatagaaaatagtggaaactgttattctgtggcctgatcccattgcttagggactctgtgccagggcatgtgggaaaagaaggaaggcaagttctgctaaaatataaagtcagggtaaacatttttatttattggagaagagttgattattatctaatatttaatataatatgcttaataaagtcagacttgaaagttggctggttggacctaacgggagtatctctaaaaaataccagcaaattaagttggatcggtgactgtatcatgatatcggagtgttagctgttttgggagtacgtgtgctcaggacttgggctgagtggaaaaccagagtatggggttagaaatggaggcagagggactaccatgtcggggaggatgcacaatgaattggacgaaggttgcaactcagtgagcaccgtacctgtagtgtgtcttagtaatagcagatgcccaacctccatgcctaactcctttgcctaccccaccagtgtgcagcagcctctgccgcaccctactgcagtctctcctatttccctggcaggagagctcagagactacttgtgaacaggcctcaatgcctatagcaaggcaaggcttgggagaaacaaatgtcctctgggagcagccttgggtaaaagattaactgcgcactgagctttagatccctgagtgagaaagctgtgggaaaatgagtgtgtagctcatgagagggtttggagaaaagtggtgacatcgcaaaaatcccaggttttgttgaagttgtctgtggaggggcactcatagaaagggcactggacgtgagcatttcccttgtagttgagatgggatttgacatgacttcctggtggtggcaagacaagaaagtggcaacctgggacagtggacctcacagctctcctgctaatggtgctgatggctaagctcagctcttacccttgaccactggaacaacttagacatgtcaccagctttctgagcctgtctcattacgatgaaaattgtgatacaggttagtgtaaggaccgacaataatgcatataacatcaataatgatggatatagaatttctgcagttattataatctggctctccagtatggtagtcgtgggccacatgtggctattgagttctaaaaatgtggctaatagaactgaggaagtgaattttcaatttgattccatgtttgttaattcgaactgaaaaacaccacgtgtgccaagtggctgccatactggagagcgtggtcaaatgacatgcctagctcagtgcctttcgcatgggaggtatgcagtacttcctgccacgatggctgttactcttgtcgttgtgagcagtgccttggtcccgatgatgattctccaaaatgtaatctctgctgacagaacaagagtctgcaaattgggagtctggaaagggaagagaagggctttgtccctggccccaaagactcagggagaggtttactggccaggtagaaagggcgtccaggtgaagggaccctggttcagtgatctccaacctgcacgtctcatttgtgaggaagccgtagggtgtggacttttcttgtttctgaccttgagtgattagaaaatagcagcttttatatgtcacaaatggactttagataagcatgaagatgacgaagactgtggaatatgtagctaagagtcttactaaaatcctctctagtgtatttatatatttaagcgtttggtagtacttttttagccatcagcgttctctatattaggttgatacagaagttattgaggtttttgccattgaaagtaatacgtcacttcatgcagaggtggaattggcgctctgagcttgcttgtcaaattcacaggcattcacttttctttcataaacatttaggactctgtatttaggagaggaatcactgtgaatgtagacctcgggttggtcattttcctagtaagatagaccagactgactggaaaagtcaccctcttgggctatcctgcgtatgtggctcggcattgcttccgtcaggataatgcatcagtttcttggacaaagggtgcatttctgctatttgaatgcagacatatttttggatataagccacgcagttgcatcccatttcttccgtaggtaaaggctgggtttctaattgtgattgagaagcttagcatagatgcaatgtccctatcaccagatggctagtgtgctctgccttgtctgccttttaccttagagagggtgcttccttctgacacgggtattgctggagtacacattctgttgcatgaggtcaggggagcaagaaatacaacccagacttgcgctcggaagccctgccttcatttcttctctgtagctggctcccttaagtattaaacagcagtattctaatatcaacgtcccttttttatttgctgtgacttgctgtgactacggtgattttagttacagtaattaggtcactcttcatggagtcgggctattttaagtgcctctttaaggaatattgttgcagatcagtaattttacaattggatgttcttgtgcaactttattaaatgtgatctgtcttttaaatgttgcccttttacagttacacatttctaattgttgctgtaaatgcattatcactttgaaattaattaatttttccattttggctgcctgcaatataataatcactaatgagaaactcacaggaatcaattctcagcacagcggcccctactggtaaagccatgtctctgcctccctcttcttcttcagatccagagaactggacaagtgtattggggcgtcctgggagggaagtgtttgtttcttcctcccttcaatttatggtgaaataaaaatcacagataaacttggaaagtgagttatttttaagtgtcgttctaaaaaagatgcaatatacttcaaatagctgcttctaaaatatgttaaaggaaactaacatttgctgagtactttctaataatgaagtcacatcatacgtgcattacatgtttattttcttgactctagagcattcttttatgcagttaaattactctaaaatgttttgcacctgcacgcattaatgtgtattgtttggtaagaactttcgagttggtgaaaaaatgtattgtattttagtatctatatttatatatacatattagtctatgggttttaattcacaaaaccaggtgttgtatctggtgcacataagggattttcaaggctaatcttgggtttttgcagttgtaaccatgtgtgatgactttagaatcctaccacacttccaaatagagatgcagattgaccattttcccagataccacgatgctttatgtatcagcatatattttcattaatttctcataatttctgttagaattaataattccaagttctacaatcttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtggaccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcagctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagtgaccaatggatgtaagtaagttggaaaagggcaaaggatttagaatcatgagggttgtattcaaactgcagcctctactcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgaggctcctcattgcatgcctttttcctttatcaagagacagagcattctgcttcagaactgtcctcctgagttgacttcccgtcagatcccactggttgggactgagtcatctgtttgtatcctagttataaaggagactagaaaagtgcataactggctttttgagcctctagagtggcaggcgaactctgattttgaggaaaaaggatagggtaatggtgttgacacaggcactgttgaatacgtatgtacatattttaatagttttctcattaatcaaatggaaatgctatcgattttataggatcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacagccagtgcctagaatactgcctgactcgtagtagcactccttatgtgttgaatgagtaaatgaagagtccctggaatttcttcttcataacattgaacacaactgcagtttgaaaacataatttctgtagttttttttttttctttttttttgagacggagtgtctctccgttgcccggattggagtgtagtggcacaatcccggctcactgcaacctccgcgcctccccagttcaagcaattctcctgcctcagcctcccaagtagctgggattacaagcactggccaccaaacccagctaatttatatatttttagtagaagcggggtttcaacatgttggccaggctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtttcttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagggacgtatccagcggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataaccattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtgatgttttgatattcatatgcattgtgaaatgactaccacaatcaagctaattaacacatcggtcaacttacatagctatcattttttgtgtgtggcaagaacattgaaagtctagtctcagcaattttcaagtatataatacgttattattattactatcgttaactgtattcaccatgctgtacaatagatctccagaatgtattcattctgtctaactgaaacttaggatcctttgaccactatctccccatttatcaccccctcccacttccccactaccagcccctcctgggaactgccctctactctctgcttctgtgagtttgactgctttaaattccacacaaaaagtgagatcatagagtatttgtctttctgcgcctggcttattttacgataaattgattgcttctcttcccattgtttatagatacccattctcgtaatgatggcactgtgtctgtcatagaaggcctaattctccctgttaacattgaacataaaaacctcatatgggccaggcacagtggctcatacctgaaatcccagcactttgggaggctgaggcggatgaatcacctgaggttgggagttcgagaccagcctggtcaacattgcgaaattctgtctctactaaaaagatacaaaaaaattggctggctggtcatggtggctcatgcctgtaatcccagcactttgggaggccgagccgggcgaatcacgaggtcaggagattgagaccatcctagctaacatggtgaaaccctgtctctaccaaaaatacaaaaaaattagccaggcgtggtggtggggcgcggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccagctacttgggaggctgagacatgaaaatcacatgaacctgggaggtggaggttgcagtgagctgacatcgcatcactgcactccagcctgggtgacagagtgagactgaaaaacaaaaaaacaaaaaaaaacccaaaactatatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaaacaaagagagggaaactagatctgcctttgtgaggctggagcacctcatcaatgtattttttctgccttgctttatagtgttttaaatccgcctcggcctttgttcctgaatgagcacccgagaaggggagaaagtgactatctggccttagtatgtgtaacaaattatttaatgaacatttaaccaagatttgcaattcccctagttttatcttcccggtttccttttcttctgtgtgcccgttggcattttggtaatgtgctgcctctttataactctttgtagctcttttattacttttcttttttcttttaagtttgtggtgccttctttgatcctcccctctttcagtttccttttctccaatttcatacttatttccagtgatttttggctgcaacgcagtttagatattggaggccagcgtgattaaaccgaggccaagagtttgtattgccccatgacgatgtttctggaatgtttcttctgtgaacagtgatttttgtataactcactggacatgttgatttttccctgtgaggtgtaaggtaatgttttcctagcaaaaacaaagagggctgaaacctggtgctcagaatcgtttggaaacggaactcctctccctcttctttttacaccaagataaagaaatactttgcaaatcagctgagcacatgttcccagctccgtgccgggctctgtggtcatgggtttccttctttatgtcttactcatctaatgtaattttagagtgtgttctctttagataattgtgtgtctctgagcaaatcacttatcctctctggtcctcagttttcttatctgtaaaatgaatcagttaaccaagaatagccatcccttgggttaatagaacagtttaacttgaaaggaaataaaaaaaggagactaacatgggcccacagacattgtatttcataaattttggatgaaaactgaacctaccatcatttattaagagaatggatattttcatgtcagaaattataggaaggatacagttatgggatgaggagcaattcttttttttttttttttgaggtggagtctcactctgtcaccaggctagagtgcagtggggcgatctcggctcactgcaaacctctgcctcccgggttcaagcaattctcctgcctcagactcccgagtagctaggactacaggcgcgtgccaccacacccggctaattttttgtattcttagtagagacgaggtttcacggtgttagccaggatggtctcgatctcctgacctcatgatccacccgcctcggcctcccaaagtgctggaattacaggcgtgagccaccgcacccggcctatgaggagcagttctttcaatggaatatatttgacttcagggagaactcactcaaatgctgctgttactgtttttccctttgttggaagtgatggggttgtacttggaatgactggcctagaaaaccctacaggtaccatttaagctccatagttcttctgtgtgtgtttcggatcccaggttccaaacctgcactaaaacttgttgctgcatctcacctaatcgtgtagtgagccaggtgagctcatctgtgaaatgcagacctttctggacgtaccacctcgtggggtgaagggaaagaaatgatacaggtgtacatcagggtataagctgtcctagagtctggattctttttatccagaagccattctttcagcctgtgcctttttgtaaataccataccccatctatttccacaaaggatttggggcattagcgagtaaagggggaatatgttctagaagaagggcgctcacctcagtaaattgatgggtgggccacaaaaatcatgtcacaagatcttgttgatgtgcatgcattcattcattcaacaaatattattgagcatctaacataagccgggtgctttgctagggacagaatgctgtacaaggtccctgtcctcatggggaccgtatgttgggaagacagatgataggcatggaaatgaagagacaaaccactccgacttcagcccaggaaggagctttaatttgagtaattgttttcactaattcatcttcacagaaagaaataatatgatcaccttcggttagtaaacaaaacaaataggcaaacaggtttacaggctgaggtgggctggatcacttgaggccgggagtttgaaaccagcctagctaacacggtgaaacccttctctactaaaaatacaaaaatattatctgggtgtggtggagctttcctgtagtcccagctactctagaggctgaagcatgagaatcacttgaacccaggaggtggaggttgccatgagcagagatcgtgccactgtactccagcctgggtgatggagcaaggctctgtcttggggcggggggcagggcaggggaggggggaaagaagagaaacagctttacttacgtttttgatgagcctagcctttgctgtgctttggaaaatgggctgtggaatttggctgaaatagtcaaatgcgtagctggctgtatgtggactgataactgggcttattttgcttcttttagatctggaaagactaagcgcaaaatagaaatgctaatggtattgatgtgtttttcttcctttggtgtgataaaaaggtatcagtagggatcattcataaaactagttagtaaactatcagtttaatgtacaatggtgaagaaatacatacatcatacttgagaccatgttccagagagtattttgtaacctgtgacgctcttttcaagtcttagagaggaagtatggaaagagcatgcgcttttgactgaggaggtcttgggtttaaaggtcgaattttgccacttactttctccatggccttggtcaacatcctgaagtctcaggtccttgtctgcctttgctttgacacgagatgttgcctgcctcaggcggttgttgcaaggactaaaatcaggaaggcctggaaagacttggaagcatttctgtcacatcccaggaactccgtaaatgccagcaagtgttagattattgtgatgattttactactcctattattgatattataattaatattataattgttcattattaccttataaaaattacttatgatatgtttttcttactatttggtgaacatcgagtatagtaccaagtgtatacttttttttttttttttttttttttgaggtggaatctcctgtctcccaggctggaatgcagtggcattttctcggctcactgcagcctccgcctcccaagttcaagccattctccagtctcagcctcctcagtggctgggattacaggcatgtgctactacccccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcctttcagaagtaaggtttttagaaaggtttgagttatttcctgttttctgaaccagacaggcagagtatttgatcttacaaaaatctggctcagttcaagttagctgtgtagctttggaacggaccctggacagatggattttctaaaattacagaggaaactagatctgtaactctgtacatttactcctgtgccagtaacaatggcaatattttaatactgtaataaattttttcttatgcatttgctataaattagtaaatctgtgtaaagctgcttattgcatcatcatgtagaatttctacatcctgcagaagtttaagaaaattgtcttccttttacagacaaggacactgaagtttagaagtgctaagtaaactgtcttagatcacttagctagcaagtgacagggatggaattgaatctgtatttatcagaggtgaaagtatatgtgtaattattcaactacacttaggtaaatatccgcatacatgcatgcctccccttagactccattgttccaaaaggtaatgacaacaaaaattagtcggaggcggaaggaaatgcaaaagtggacatttactcgagaaagaataaagaaaccatgcaggattccatttcacaaacctctacagctgttgctggggagtcagtggaggggtactggaggaaggcagactttgttctaagctacttagcagccaaggaaagcagaagaaactattattattatttattattattatgtgagttggagtctccttgtgtcatccaggctgaagtgcagtggcatagtctctgctttctacaacgtccacctcctgggtttaatcgatcctcctgcctcagcctcccaagtagctgggattacaggcacccaccactacatccagctgacttttgtatttttagtggagacagggtttcaccatactggcccagctggtcttgaactcctgacctcaagtgatctgcctgcctcagcctcccgatgtgttgggattacaggtgtgaaccactgcttctggcctagaaactattattaatagaagttctgggacaacggccctgctctcattacttgcccccaatccatgcaatgaaatactggcctgtgagtatgtggtcccttcagctcattttctgaagctgaccaaaggagcacagtaatgcataacgggggagtaaaattcctcaagacgagcaaaaaaggcagaaattaataaaactctatgtattagttatctatcactgcataacaagttacctcaatatttagcaggttaatacaatgcacattcattattttatagcctttgtagattaggaaccagccattgcttagctggaccatctgctttagagtctcacaggctgcattcaaggtgtccactgggctggggtcaacttcttaccgacaaagctggtgccccaaaagaatggggtcttatcctgttgggtgtcatgaagccaacacacaaaaccgaaagtagtgtcaagcagtacaggctttattcaatggccatggaattgagaagcaggagcatggctcacaaattcacaaatcagcttctccactaatgaggggtgaggaagttaaaatatagactttgttgttgttgctgttttaatgaagaggctggacattaaaatcaaggggaggaataatcatgtcttctcttgaaatgggcagtgaacttcccggaaccagagtgttgccttcctttttatccttttatggctgcttctgatcattgtcatggtgattgtcaactgtcttggcgctggtgagggggctgtttagcatggaaataggattataatgacacctgaggtctttttgaagtccttgggtcggctatcttgcttctaacaaatctcagctggtctggttacagagggaactttttatcacaggtgtcctgtttcttaaagataagcagtgttattacagggtagaaattcacctatgtcaagtaggcattataccaggtaacaatctcaagactcagcagggaaggatccacttgcaagcccacgtgcttgctggtaggactcagttccttatggcccagtggattgaaggcttcctttcctgcctggtgtttggttccttgccacgtagggatctccatcatggctgctggctttatcgaagcatgtaagccaagaaggaaatagaatccattggtaaaatgaaagtcacagttctttgtaatgtaaccacggaagtgacgtcttactgcttttgccatattctttttgttagaaggaaatcactgagtctgatcgttgttaaaggggaaaggatttcacagtggtatgaatcctgagaggcaggggtgatcagggccagctaccacactctacaacttgaattttgttttagatttcagtgccttttggggaccctgctacattgtggtagatttactcacaggacttgatgatttttcttgacctgcctgaagccatagcatttattacggataagtttgtcttttcttcgttctttttctgtttgcatcctttcgtcatccttttcttccctctttctggactgagagaggcaccaaatgcacccatttaaaacatatatgcatttctgctttctgatgggaggtaagatttagtcatttaataagaaagcttatgaaaagaataaacaaactggtagataatgtatcctaaagtcaagtatttgctttcatgttgctttagtagaaggggcccttgttaatcgatggcccaaattgtctttctcaagaaatgtgtattgcagaatttggatttgagttacaaaaactagccagaaagcgtgaactttttttttttttaagccataaagcttggtaaggctagccaatcatttcaaagcctgtgtagaatatctagactatatgtaatcctaggatttgttgttgttttgttatgattttttttaagcaggaagctaaaaaaaataaccacccgttactttgctgcttttagaaaataggtttgagattgattttgaatactaaagtatagttttcatgttataaagccaaccatgttaaaaatgtataataaagtatctaatttagcaaaattcaaatttcccctatgaaatatcaagctctttttatgcttcttcacatggcaccttgtgtagaatttgaaccactttaaacattgcatccttgagttgcatatgatgggatctcttgaatcatttacattttgaaaaaagaaagtgaaatattctttaagaagccaaagtaatccacgagaatgtatggtgtttgttcagctggatatcttatttatttgaagtactgagagagaaatcttttctgactgctcaaaacagggaataataaacagtcagagtgtccaagtaatctgagctagaaagttccttctttcagagaaaagttataaaaagtatatttgccggatccaaaaaaaatactgtgtatcaactactgagacctgcataatgttttcttagtattctcactctttaaaagaaaaaagaaaacctgtaaaatttgggaacttaaactttttttgatattttaatatttctaggcaggtgagtgcaataagtctgttttttgatcttagaacataacatttcttgttggctattgtgtgtgctatgtgtatgatttgtctctttgttaattctctataaatataaaagagcaagtaatgaaattaccatggctgaattctgaatattaacccagagcagatttcctctaagaaagatcataagaagatgcttaaaagaaaacattatatttcaaaagaattaggttctgaaatatacccaataatgaaaacaatacaattttcttctgctttttgtccttcctgttccaagcactgggaaggagctggcatatttcttatgtatgaaaagtagaataatatattggattcctttatccctaacccggaagagtctttcttggactgtggtttgctttcccgttatacttaagcttgtttattgcatcttccgatgtcacattatctcattgccaagctaaaggctctgttgggttcttagttgaacccagagtggaggccgatttcatccaaagccattttttttaaaattagaaattaaactcacctttggcaagtcctcctgaccagggatgggtcctcatgttagtctgtaatgtgaagatatgaaatgtatttgatacaataggagattcactgtgattttcactgaatgagtatacattctgcagaactagaagataaagataataaaacaattcacatttcttaggactaatttattttccacagtccactaccaacatggtgggatggggaggagctgagaagagcatatttggctgagtttggttgcagaaggatgcaatgtgaggtagcagaaggggctgtaagaacacaggattttgaagttgaagaaaccagcctggaatgaatcccagcccttccttttagtgacctgctggccagccacattacctccttgggctttggattttctttttcactgtaaaatggggaaagtagctcccacatctttgggctgttggtgggaggtgtgcaggacacagctgaaacctttggtgtatagtggatactaaagcaatgctagtcttcttcgtgtgctaccagttagaatgaattttgctgacatcttactggtttctgagggtatacagacacttattgtcaaagatattattgattatctgatccccaaacatatggagttacatcacagcaggtgagaaatacccttcaactcttgattctaaggaaaatccttggggagccgccatcattccttccacgaaggaatgaaattataacgtaatgtattgttggagcccttagttcaacactgtcttttttcaggtcatattaatgcaatggttagcatatcaacttccttctgtttttagtgactctaatacattatattcaccttgttctctgcatgttctttctttaagtcatgttagatcccttttttggaagcaggtcaaatttgaattaataaaatgatttatgttgaagtacaggcatatcccacagaatctcttaataccaggccaaaagtaactttatcttgatctgtagttcggacatatttcttggattgtccgcactcataaaaagagattgcgtaacaccctttgaacaaatggatatttgagaaccatcctgtcttcagatttagattttttcaatttttttttactgtcatatgattcacatgctagttactgattgctatcatgcagtctgccagcagaccagatggcagatcttttaattagatatgtttgtgtgtgtatgcatgtgtgtgtacatgtaatcacagttcatcaaggacctaataaatacttttttctctctctctctttttttttttttttttttgagacggagtcttattctgttgcccaggctggagtgcagtggcggatcttggctcattgcaacctctgactcccaggttcaagggactctcttgcctcagcctcccgagtagctgggactgtaggcatgcactaccacacctggctaattattatgtttttaatagagactaggttttaccatgttggccaggctggtatcgaattcctgacctccatgtgatcggcctgccttggcctcccgaagtgctgggattacaggcatgaaccactgtgcctagccttaataaatacgtatttatgtctttcgatctttttctgtttttctacattccgtttcccctatggctgctattgttttccagtgagctatttatatatatatatacatatttttgagagggaatcttactctgttgcccaggctaaagtaccatgtcaagattatggctcactgcagcctcatgagcctcaaccttcttggcctaagtgatcctcctctctcagcctcccgagtagctgggattacaggcacctgccttcatgcctggataattttttgtatttttgtgaagacgggtttcatcatgttggccaggctgcagctatttatatcttatatgtgtatttgtaaaaaatttattcctcagccctgtgtggtagctcacttctgtaatcctagcactttgggaggctgaggtgggaggattacctaaggtcaggagtttgataatagcctggccaatatggtgagaccctgtctgtactaaaagtacagaaattagttgggcatggtagcggtgcctgtaatcccagctgcttgggaggctgaggcaggaaaatcgtttgaacccgagaggtggaggtggcagtgagtggagatcacgccacagcacttcagcctgggcgcatgagcgagactatgtctcaaaaaaaaaaaaaaaatttcttattcagttgatttaagatggtttataaagacaacatgagctagcggtagaaatgcgaatggacgcttgtagacagtaaggactcaatacgtgggtttgttcaagttatattgtgcagacaggcatatgcagttagaaaatctgtctagggtagggagagataaaaccagctacttcagccctgctatttttatcctgaagattttttttttactctgtttatgaataaaacattttaatcagtgctgtatcaacactgatcaatttttttcatggaagtgtaatacagggtgaattccattaagtcaattaaatacttagatccagtttttaaacagtgcgaagatagttaagctcttcttttattgaaagcctttttaccaaaaccatttttttttattttatagtgaagatttcatgtatctgttttctgtacatgccaagttttacagctttttgtatcatgagttttcttttgcatcaattatttctaccaagtccaacttgtagattgggcagatctggatttcaccacacctggtttttgttgtcattgagtttttgtgatggggtgatttcagtgagaaatatatgccattaatttgatgaaaaatcagtatttatttattaactaatacccaagaaattccccagcaagcctcttccagtattctagagtttctcgtttcttgaggattggtctccgggcatactcctaatctaattgtttcccaaactttcaatgttttggatgactttggaagccttgatttctgtaggctgtagcaggacaaattctgatggacagatcaagatgttctatgttgctctaaaacagcatctctcaaacttttttggaccactatctaagttttttctgttaaaacccaatacatttatacttatgtatattcgtgtgtgtgtgtgtgtgtgtgtgtattatatgcatgtgtgtgtatttgtctgaaataaaagttttacaaaatgatacttttatctgagcagtgtcctgctgttttttttcccctaggttgtgtttttgtgtttttgtttgtttgtttgtttctttgtttgtttttgagacagaatttcacttttgttgcccaggctgcagtgcaatggcacgatctctgctgaccccaagctccgcttcccaggatcaagcgattctcctgcctcagcctcttgagtagctgggattacaggcatgcgccaccatacctggggaatttttttttgtatttttagcaaggttgttgatcaggctggtctcgaactctcaacgtcaggtgatccatcctcctcagcctcccaaagtgctgggattgcaggcttgagccaccgtgcccacctgtgttttttgttttgtttttgtgtatgtgccaatgatgacccagtttcaataccaactgttgctttcaccacccactattggtttcaccaccccgctagatcacagtctgttctttggcagtcactgccccaatactgtttgatgtgctcccctctgataaatgttcattgagtgccccacatgtcaggtactgacttaaggcatagcaaatgcaaaaatgagcaaggtgttctcttggctctatgggtgcctaccttagaaggatggagatgggaagaatgtgaaagggaggtgagatgagcagcactgggatgtgtggcttttctgtcttgaggatagatagaagaggagtcagataaagttgcagaacagagatgacgtctttactgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggccaaggtggacggatcaccagagttcaggagtttgagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacagagcaagactctgtctcaaaaaaaaaaaaaaaaaaaaaaaaaaatcaaaattgatgcaaaaaatatgataacatttcaaaatttaaatcaagacaaattcaatattatagcaaaggttcaagtaatgaacatgaatttgtaatgatgcctgggggaggtgaaggttaaaaaaaaaaaaaaggccaccaaggacctcatgttaaagttgatgatgacggaagtgagcagtgatgatgagatttaaaaaactaacttttatttttacattattttaactagtatttgtgttaacattattttaatctcctgtgcacttaagggagctggcataggccggcagtggctataggccaggacctgtgctatgtagcttatctatttctcatgctgattctacttttgttactaccgaaggagcttagagggaatcagtgacgtggacaaggctatgtaactaaagggggtggaggaggattcaagccccttgcaacggactgaagtgcccaagctctaaatccctgccacccacagcctctgttggccccaggttgtgtctgagattcagaggttgtttttatagcagcaacacagtaagttgggaagagggacacatttttaacatagacaccaaaagagaggctggaagagttgaccacttagaaatgtcacgagtgtctgtgaatagtgttgggggctgagaggcaagagaagaaaatagtcctaatgttgtacaagtagcaatggaaacaaacttgttaaaaaaaatttaattttgtttatgcatgtgtgcataaacaaagcaatagaaaatatttgatatttaagattgagcacttaacaaaatactttgtctctttttggtttgctgtcttaagcaatagccttaaattcttgtcccagggatacctgatagagctaatatagaacaatattttaacataatttgaagtatttttttcttctgatgggtatgtagttcatttttataaaaaaatttaaaaattctgaatctgtggtgtttctgaaacatcctgatatattttttgttgatgactcttaacaaaggatgtaagacagattctaagaagagaaaaggtagaatatccacatgtctcagtttcataatatgtgtaaaaattatcatgcccattcattatttaaagtgctgtggctttttagtgaataccaacattaacaaaccatgttaacatgatttaaaatatgtaatgaaatttgcaatgcatcagatgatggaactatcaaattagttcacgtggcgttggctgatcacccttatgaagagttacttgcattgtttgaagagggaagatgcacatccccttgtgggctggcagcatttttgctaacactgccttaaatgatgctactggcaggatggttaatttgatgttgaaatgtcacacaatatgtgcccaccctacgatttgaatcttctgtgccgttaagggaattggcagtgttcagacagaatggtaacattctctctgatcgtgtctgtgtctgcacccttttttgttttgtttctgttgtcttcattaatagacctttcaggaaccttcctgggatctcagataacagttcttctggaacaggattatccagaggtagcaaaagctctcctgcaaatattccattgcacgactttaaataaagcagcaagaagtcttttcattcagttcagatttgctacttgttctcttggttccttcaaagtaatgactaagtacaggtctttagatagagagctgcaccaaccaggtattgcttcgtgtcttccacgtacgtcctgagaaagcgaaggtgaatttcaccaattggtaggtggaaatagaaaaactgttgattctttttttcattcaccaatcttttttttccccaaatgctaagctttatttggggaaatcttaacagccgtttttataagactctgcatttacaacatttgtgggggctgcagaggacgcacatgaaaataacatgaactggccatgtacggtggctcatgcctgtaatcccagcactttgggaggccgaggcaggtggatcacctgaggtcaggagttcgagaccagcttggccaacatggtgaaacctcatctctactaaaaatacaaaaattatagctgggcgtggtggcgggcgcctgtagtcccagctacttgggaggctgaggcaggagaatggcctgatcccgggaggcggagctttcagtgagccaagatcgccctactgcactccagcctgagcgtgagactctgactcaaaaaaaaaaaaaaaaaaattagctgggcgtagtggcaggtgcctgtaatcacagctatccagaggctgaggcaccagaactgcctgaacctgggaggcggaggttgcagtgagccaagatggtgccactgcactccagcctgggtgacaaaaaaaaaactttacctgggcttagtaagttgcctgacttctcatcctggagttcgtatccccttgtttctagaagagaaatccctcagatgtgaaggtgtgttccatgattttgtcgaacttgccctacatactgttttattatatattctgcccacttctattccctgccaattaattaattgtttcattggtatagttttttttttttttttttttgatacagggtcttactgtgttattcaggctagagtacagtggcgtgatcacagctcactgcagtcttgacctcccaggctcaagcaatcctctggcctcagcctcccaagtagctgggactattggcaatgccaccatgttcggctaatgtttttaattttttatagagacaaggtttccctatgttgcccaggctggtctggaactcctgtgctcaagccatcctcccacctcagtctcacaaagtgctgggattacaggtacaagccaccatgtcaggccattggtataccattgtttttcttaaacatttatttattttcttatatttacagcatatgtggtcatttaaaattattttatagcatataaaagtaaaaagaatataaattaattttttagcattaatattagggaagataatctgacatttaaaaatacatgtctatatgtgtatacatacatagaagtatatatataaataccagtactagtgtctgctaataggtggcgccactttttatctgtgtgtgttgggggtggaattagcatgtagaggttggcaaaggggacaggagactgtgggatgattagtatattcttatttggcctgggagggaaaaaaaatctttcatttccaacaatattcattctctgtgtcacctcagcatttaatttacttccgtcacaaaactacttgaagttgtcccaggctagttggtcctattaattacaacctagagggattctattagtaaactaatggattacagtacctaaatggaagccagcagatgactttggaaggactgatccgcaagggccttctgtgtgaagattaaatgaagcttcctttagccttctcaggtggccacagtttcccataaccttagagattatctaggccaaggctattaatttagagattaagaagccaaacccagaaaggttgaaagactgtcgtaagttcacactgaaagagagtggtgtaatgcccttttcaccaggctccaagaaatttgcctattttatgttttaacggacatggtatccccagcatttttaataaatgcccttttcttgcataagtaactggatatttccgagtggcctacaagtggagcgtgatttcatctttcatcaagagaagcagcttttcctcctcttgtatccgttttcttccttttctaactatcaaggtcatgcggtatctgccattttgcatattcttgctttgcttcatgttttccttaaactctgtgcacatgaatatttgtggtatatggcttaattgtaagcgatcaggcatcaatggctttttatgaggcaaaatctactttctgcatttgcgtgtgccattattatagattgctgatgtttgccaatggatattcttggaagtcgtcttctggtttaaatgcagttaagtatttaaaaataataccagtgacatgtttgcatttacattcagcctgaaggcctacttgatgctgcaactgaaaaattgttagactagattttattttattttaattctttttgagacagggtcttagtctgtcacccaggctgctggagtgcagtggtgcaatcatggctcactgcagtcttgaccaccctggctcaggtgatcctcccacctcagcctcccgggtagttagggctacaggcacacgccagcacacccagctaattttttgtattatttatagagttgggtttttcaccatgttgttcaggctagtgttgaactcctgggctcaagcaatccgcccacctcggcctcccaaagtgctgggattacaggcatgagccactgtacctggactccactatgccttcccctccccttccctcccttccccaccctaaagagtctcgctcttttccccaggctggagtgcagtggcactatctgggctcactgcaacctgtgcctcccggattcaagagattcttgtgcctcagccttccaagtagctggttttgcaggcatgcaccaccacacccagctagtttttctatttttagtagaggcggagtttcaccaagttggccaggttgttctcaaactactgacctctcctcggccttgcaaagtgctgggattataggtaccccgcctggctgatactttccttagttgttttcagtgtaataacctgtcttcagtctactctttgtccttttctctcctttcctccctgaatactcaagcttccagtgcacagatttctccaaccctgaatgtgactgataccaacaccatactagctcttccacagatgcctgtttgttttgcagaacactggcctgaatgactcagacttggagcttgaaagagggagaactgatgtggcctgtggcagacgtgtccaatgacctgctgtgtccttgcttttgaagaactaaagagtagacttgaccactttttaaacatgacattcgatccacgtggcatagcaaggatgggatccacaagatggagtgatctttacgccatcctcctgaccataaatactaaatgaatactctatttcagttgagtttttagtttgctctgttacgtgaggacacatcacttgcacctcagtgtgagtttgaaagtgttttctctggagaataattctgaagaaataggccctccagatatcagtagtgacaggggtatcagtaatgttgattactaagttcttgccacaggtagaagccatgctactgcacaagtttcatacttgaagagtggacatctgacacagtgttggtggttgttgaagtgtatgactattactgtgttgctttggaagcttgatgccataacaaaagtgcagaattccatgtttgataactttctgacttgatgaaaatgaattgtggatacagatttcactatccatgaattgtggccttaactttctcatgtacttactttaaatcagagagcccacctgtccaattctagcttctcctgggcatcctgtatttgacacagcccctcccagcattctgagtcatcgtctgctgctcttgcactgtccgttttccaaatgaggaactcatcggtaaggccagaaaggaaagggagaaaaaacaaacaaacaaacaaacaaaaaataggaaaaaaagaaagagcgtatttatagatggtagagaattctgggcatgagaaacccagccaaacaagtggaatgtgtgcataggtgggactgctgatcttgttttatgaaagaaataaaggcaagtcaaacagatcctttcgcaaggatccccatgtgtgtatgtctaacccagtgacaggtaaggcagccaggagctgctgttatttcagtgcaaagctgttttcacaatcacagacatgcacagctcaaaaaccctcacaggtcacgcctgaataccttcaatgtgccccatgtaaaaatacactgcaagtcgattggacatgccctatgaattataccttatttatgatcgtcgagccctcccttttcccgtcatgctttagaattatgggctggagcagtttttaatactctatttattttaggggaggaaaatgtttttctttaaccacaacattcatgcaataccaactgctggcagtttccccagcatttaaggaaatattgttgtaagacttttatgttctgtacttcaatcagctagagccagcagtatcccaatggaaggaccctcaacagaccattttcagcattttgctacaattaaactcctctggttttagccctcaggcaatttagtacctttttacatatgcacattatgaacttttgaccagggtctagcagtcatatattagaatgctgctcttgaaggcaggcttaacaagttcctctgagtattacagttggagtcagttgtggaaaaggtaatttaagcaacttgcagcgaggccattcagaatctcagcgatgatcctaaatatctttctctcttgctcacgctcttttttttttttcttgtttcctctggaagctggtagcaggagctttcaaagtctgtgattgatcttttattcagtagctaacgagggctgtgattctattagcgcactacaaggcaagagaacagtgatttaatgaagtgtctagtgagccggccatagatttatcctgttgtcgctaatttgcagcgcacttgccagcataaaggaaactgcactcacactgctattaagcaggtatttccttagtaaattgttgtaaggtcaggtacagttatctgagcaaaagcaatgccttacctcttcagtgtctgcaaatgacagccgccgtgctgagcgctcactgaagtggaaccgggagatcagaggtccgtctccaagtcgcccttagcggaggcaggagcagatgaactgccaagtaggagtaatagagtcataattggtgattagaactggaaaggtgcaataacatcttaatacaaactggcgtatgttatagttactgtcagttgttgtaaactcgtcctgccgcctggactagttacgcttcccttgattagctctgagaaacgaggcagcgggcactggggcagccacatagacaacatctaaatttttgttgctttcctgggtcttgccctgtccttactgtttcccttgggcacgctgttcaccccttaggacatactacagtaaccttttcccaccaccgtgggaggactgtgattttgtaaatgtcctctgatctctcctctttgcaggcgcagtgacatttatgcacactggctttgaggctcattgatcttttgttttatttgcctttgctgaggcaggggcaggtctttgtttcatgtcagatccgtatcccactgcaattctgtgttactgtaggagatttggggttggcatgccagagtgaaaacgcgaaagaaaataaacaggcagcactgaggaattatacacttgagcttggcatttttcttaacgcagggctattttaggtgcactgcgcatgttggaggtgcccttgcaggtataggtaggcattgtccatccgtggtaaaaagcaatagaagaaattcttacccgatgcttaatgaattgccaggctggttaaaaaggataacccttgaaacctagggtgtccaactgctaatttatatagactggagatatttccatgcctcgcagcaaaatttttctttaaattcacagaagcagcagctatccagcattgtccagttgtgctgagtagctgtcattattgataaacatgtaactggtcatttgtattgttttgagtaggatatggcttatcaggatgcatagtagagaaaaatgagatgaggtaatgagatcacatacactgaagcatcttacgaatctggcacatagtaggttctcaataaatcttttttgattctgtgactgttagaatctgttggctgatactctgtcatctggctctcactctgctccataaaacttgggtaattctaatgcttacttcatcccagggctgatgtgtgttaggttagggtttatgatcaagtaaagagtttaaagaagtgttttatgagggagttttgtttgcaaatgatcacctggtaatttaagagggtgagctaaacttcctccttttctagtatggacctttggggctcaggatgaggatgttcaatttgtactgctggtggagctgcctttccattaagtgagtctttctccaagggaacagaagtcttaggttgttgatctggcggtcagaacctaggacaggcaaggcagtgggctgttgtagaggagatgaagctgatcagagcacacccacaccagtgacaaccggtcaggacctgggaagggctctgacccattcatctgagagatgtggcatgaggaacactgagacctaatgcttattgcttaatattgtggacaagggactctgtgggttgtctagtactaagcagaatggaagggaaggatggaaggaagagagggagagacggagggagatggaggatgacagggagatggagggaggcaaaaagaaaaagggagaaggaaagagaggaaagaggggaagggaggaaggaaagaagagagagaaggaggaagagagggaaggaggcacagaggtagagaggcagggagataatggagatcctggccaaaagttaatgctccgtttctagtagtccacagaaagcaccttgaccaagtgactgaatacaaatcgtatcacaaactactaggatttcttgggtgcttaccatgtgccatatttccttgaatcttcatgacgatccttcaagggatccttgttttctaaagggtaaaggtgcaggttagaggctatgtcagaagcaagtcaggatttgaaggcagatctgtctgcttttgcccctctgtaaatccagagctgctgcctcatttcttacgttgcccccacccgtgcagcaattcttcctgggaggcctcattgttcatattcataaagggccccattcagtctcctttttggagaaatggccactgcaactctctgttctgacctggggggaaatgttagaccctcaataaggagaatcagagaaagaagaaataaaacatattactccattcccatacttctgtgaagaaatacccgagactgggtaatttataaagaaaaagagatttactgaactcagtcgtttcacctggctggggaggcctcaaaattatggcagaaggcaaaggaggagcaaaggcacatcttacatggcagcagacaagaaagcgtgtgcaggggaactgccctttataaaatcaccagatctcatgagatttattcactatcaagggaacagcacaggcagatcccatggctttgactcagttacctcccactgggtccctaccatgacacatgggagttctgggaactacagttcaagatgagatttgggtggggacacagacaaattgtatcatagaatcataaaaattgctatttctaaggcagatgaataatcctggttggaaatcatactgatttagacttaaaaccattcagccttctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacaggtgtgagccaccacacccagcctgggggagggtttgttaaagaactgtctgttttatcacatgaccacaagttaaaatgttgggcaatgtccctgaatgataccttttcattagtaactcacatggacccataatctctgaatttaacatgcttttcaggaatgtgttcatattttccacctataaaacctgttttagtaatttactcccttgtaaatgttccttggtatgtaaatttagcatatttccttttaattgcccaggtaaataatacccaccatcagagggcaccagtagtgtaatcaccttattttttaaaatgtattctgtgtttcatgattttttctgaataactgatctttacagtctgaattgcattctgttgggcttgacttatttttaaattaaaagagactaacacattaaacactaagaggtcacataggatattccatttatataaaatatgcagagtaggcaaattcataaagacagaatacgcatcggtggtttctggggcggcggggagtatggaaagcctgttaatgagtacaagtttctttagttttttttggttttttgttttttttttgagacggagtcttgctctgttgcccaggctggagtgcagtggcaccatctctgctcactgcaagctccgcctcccaggttaatgccattctcctgcctcagccttcctagtagctgggactataggtgcccgccaccatgcttggctaattttttgtgtttttagtagagacggggtttcatcgtgttacccaggatggtctcgatctcctgaccttttgatcagcctgccttggcctcccaaagtgctgggattacaggcgtgagccattgcacccggctattgggtacaagtttcctttggggtggtgaaactgttttggaactagaggtgatagctctacaacactgtcaatgtactaaatgacactaaattgtacactttgaaataatttatgttatgtgaatttcatctcagcaaaaagaggctaacacataaggagacatattttgatacatgtggcatattaagctgctgttgttgttttttaaatattccagctgcgtgcagtggctcacacctgtaatcccagcactttgggaggctgaggtgggtggatcacttgaggtcaggagttcgagatcagcctggccaacatggtgaaaccctgtctctactataaactccgtctctactataaatacaaaaattagccaggcttggcgctgggtttctgtaatcccagctacttaggaggctgagacaggagaatcacttgaacccgagaggcagaggttgcagtgagccgatatctcacctctgcactccagcgtgggcaacagagcgagactccgtctcaaaaaaaaaagcacaaaaaatttttttcttccatctgtatcacacagttgcaacgttgtagcatgggcaggaaataattgggttgtatgtaatgcccagtaaagtaaacagatcttagagagggacaccgatccctaccctgcatggggttattcacagagccatggggacactaaacgtaccttatctcttgaccatgctattgattagttatgtgtttgcctgtgttattaataatgtatacattgaaaaatctatgtgcattatagtctttgatcttgtcatgaatttcaaagccaaagattccattttccttctttttaaaaaaaatttttcaaagaggtaggctggaagtaaatttaaaaattttcccctttctggcagagggcttttttctgatcaccacccatgttaattagatatgcatgtatgtgtatgtatgatgtatatacccatatacacacagtctatatatacatgtatgcgcacatacacatattttaaggaaagaattataaaatgatcaattcaagcttactatatgctagaggtgaggaatatttgaatacaagtcttatctagtagattaaaacagaaattaaagactgtagactaaggcaggatcaaaggacctcttttcattgttcttttattgtttattgacttcaaaaaagactttttagtttaaactgactgtaatgtctcttgaatggtcttttgtaaaatgactttgaaaactcggggataatgtcttcattaagtggagaaaaatcttggggaaaatataactgtaacttggctttcattagagtagaaagagataaagctttgcttaattaatgtctgttttccctctgttcagaagtataaggaaaaaggggactgaaattagtgctgataaaagcttgaattagacattatagcactgaaacttctttttcttccttacttagaatttggaagaacatacttcatacaaagctatgaagcatattggaagattttaggtgccctgtcttcctggatataaaatgactccaaactcagtgatactgatcagcctggcttcttttccacctttctcacttcattgtctttttgtgtgtttctgacatctgttgacaaatgggcaatcttggggatggggggttccactggtatattttctttactgtttaagaaagctcaaaattctctctgctcttttccaagccaccaatcaaaactgacattttctaagtgtcctcattgccctctgggaatgttcatggcctctgggagtccaagaactacctttacactggatcttcactgcttttactattgtgtggctttctaccagttctctgctcagcttctcttttctggagacctgatatgctttgttagcttagcatgctgttctaggctgcctttcttttttttttttttttttaaacttcatggtgagcagaacactgtactccagactgtgaggccccacctgtgcagcctgctggcttctcataccagcttccttctcaccttaaccccacgtattgttgcaacggcaaaaaagagaattgcacagaggaacaccacctatcagagttcacactgagtttgcagattcatccttttgcttccagccatcccatggaatgctgttcttggaagggtcatctcatggtccattgtcggccctcttagaagagatttcaggccttcccttgtagcttgatagttacagggagtgctagggtaagtggaaaaagcacatgacttggaataaagacttagtacacatcccatgtctgatttatactaactagttcatggacctagcctacgttactgcacctgtttgagcctcagttttcctgtctgcaaaggagggatgatggtacttacctcaaagaattgtagttggatcaaatgagttggagtgggatacagcaacaatctatattctgatttcagcaacactgtgcagtgtaattccatattatattacaccacatcttctgtgggtctttctttgggggaagctaacattttaaaaggtttccctttgtaacctgtaaccccctctaccccaaaagtatattcaagagcgaaacttttggtatgacgatgtcttacatcagtagttctgaatgacttgacttagctatctttcttgagtctctcaaaagacagatggatggatagattgattttgttgtaacacctgttcagttttgctggccttactcgttttcaaatactcaaatgccattgagtcagatttcagaggcaaatggtgatacctcaggtttgaagttgcaagaagtcaccacatgcttgttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcagactcttaagctacaaaatacatctcttcacaggagcacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgcgcagatagtggggaatagtctatggattctgcttacaccatggacaaccaggctgggccatgggttgtgttttttttcctctcattttatagaaatgttaccaggcatattttccctgtttccctaagaagagcttcctctcagtgctagccagccacagggccaagtgacacctagaggtgatcctttggttatttgctaaacagatctaagacaaaccgatatctgtaacctgggattagatagagccaataagatgtaactgaaattctcagggattctaagacatctacattgtatgttggtacgttattgaaggtgatgctagctgctataacaaataagcacgcctgtgcacagttgctcaaagatagtagaagtttatttcttgtttatgtaagatccataatgactcttgccaattagcaggctgctctcttccaagtggtaacccagggactcaagctcttttcatcttgtggctcagccgtctgacacatgtggcttccagcactgccctgctgttgtctgcacaaagctggtggaagaagtaggaatttgcaggaccatgtgtggagcattttaaggatgaggcctgggagtggcacaaatctttgaactccaggaggctaggaaacagagcataaccttgtgcccaggaagatgcggggcatagtacatctttgcctcacctgatgtattgtttgtttaaaatcactttggattctcatttaccttttccccctcaagatctttgtttttgactttggagataaccagaaataactaagcatgcttccttccctctacgatttcatcctcatggggaagcaagaccccactcttttattttcatgtatgtatatatgtatgtatgcatgtatgtatgtatgtttgagacagaatcttgctctgtcgcccaggctggagtgcaatggcaccatcttgacttactgaaacctcctcctcctggattcaagccattctcctgcctcagcctcccaagtagctgggattacaggcacgccaccacacctggctaatttttgtatttttagtagagatgggggtttcaccatgtgggccaggctggtcttgaactcctgacctcaggtgattgacctacctcggcctcccaaagtgctgggattacagtcatgagtcaccatgcccgaccagcaagaccccactgctattgtccagtgtggtaggtacctttgcctaccttctactctacaggctggaacaggtgatattgtgcctacttcacagccttcctagcaactgaggatggctgtatgacagattctagccatcaagtaaaatcagaaaccaacagcacgtttccttgaataccttttgctttctataaaatggtgtggcattgctggtattttcactcttccttcctaccctggatgctgatttgatgcttccagccttagcggttttcttgcttctaggactgaacagggaagagggaaaagtcaaaagaatgacagaaggtcctcacgttgcagaacactgaccaatgttggcaactacaagacaatcaggcgtgattcttcatccaggatctgcttttccctgtcctgccaattcttgagctgctaataaacattctgatgcaaacatggaatacagatttcagagggattctgggtagccctcggagatgaggatgctttgcgaatgtaacaggcatctctcacctcatttgtctggtggaatgtttacaaatgctaattaagttttgcttcaaatggggaacagtcctgtgcagtgtttctaggaagttaccagcttcatcataggaagacgttctccatcgtttggatctttttcaccagcaccttttgattgtggtggtttgggatgtgatgatctcagaactttacatcctccatgaaatctctgcagcgatagttgaatgtcttgccttttctattattgccctttttcttctgtgactttgtactgagacacatttatattagggtaatggcctcatgctatttgaaaatctttatttgggccacattggttggaagataaaaatatataagcaatagtccctgaacatcatttggcctgaactaggctagagtttctcttaatcaaaataataacgatgatttttccatgccaaggagtggtgtcatatcatgaagtagatttatgtacacattaaataaacttttacattttaatgtaccaatttgcaatttttttttctattcaccaaaatattccagataacggttatcagtttttgattctacacatacttcaaatactattaatgcaaaatccttctttagaaatgttacctaattccaatgtttcactttattcagcgaagacattcctttgattattctggttaggtgttatgatgccaatttgcccacacattttttcttaggcgcctatgcttgcagtagacagagagttgaggaaagctcaaggttaaaacaggaaaaagtaacacagtaaatacctatttttgtgcataattcaaattaaaaccccaaccacctagaagcaccaatacaaggaactggctgcatattgcattcctgtgacctgctgtcttaatgatggaatgactaacgaggatcagagggaatgtggtcagcctcttatctcataagccaaatgctgcatattccaagcctgtcaattctgaaagcccttgttcatttttaaataatgaaaaactttggggccttgttcattgtttctaaaggaagacatttagaaaatttagaatataaatttctgttagtagaaactaatttctcttgcttttctctaaagtatacttgatttgaaatatgtgccctgaagttttgctatgttgaaaaaaatgatgagccgggcacagtggctcacgcctgtaatcccagcactttggaaggccaaggcgggtggatcacctgaggtcaggagtttgagaccagcctgaccaacatgttgaaaccgtttctctactgaaaatacaaaaattagccaggaatggtggtacacagctgtagtcccagctacttgggaggctgaggcaggagaatcgcttgaacccgggaagtggaggttgcagtgagccgagatcttgccattgttctccagcctgggcgacaagagtgaaactccatctcaaaaaaaaaaaaaaaaaaaaaaaaaaattatgtcatttcgttgtcacagcgtcagcagaataaatcttagatcaagatgggattactgcgccactcccttcttcccagtctgtggtttagcacgggaaaaagcaaactagggcccttgggccaaatctgatctgcagcctgtttttgtgccgcctgcaggagaacatttttaaattgctgaaaaaatatgaaaggaaaaatatttcaaggtgtgtgaaaactacatgaagtttaaacttgagtgtccttaagtaaagttttataggaacacagtgttgcttatcttttatgtaatgtttgtttgctttgagaccgagtctcactctgtcacccaggctagagtgcagtggtgcgttctctgctcactgcggcctgcatctcccacgttcaagcgattgtcctgcctcagcctcccaagtggcttggagtatagacacgtggcaccacgcctgggtaatttttgtagttttagtggagacaggatttcaccatgttggccaggctagtcttgaactcctgacctcaactgatagacccacctcagcctcccaaagtgctaggattacagacatgagccgacctttttatgtattgttgatacagtatgacaagggaagagttaactgattgcagcaggttagagcacagcatgaagagctgacaatattgaccgactggccctctcagacaaagtttgccaacacccaggtgagcagatacacttatctgtgagcagacgtgattcaggggagattgttgtccctcctttcctaagaaaatgtggaaagatgagaatgttgccaccagtgctgatatggagcgttttttttggaattgtcttaaacaagtcccaaccttgactttgcctgtgtaccctactctttactcccaggtctttgcaaggtaagctgtcaggtgttagctgaagatacggcagcccaccagtggtcccctgaatgccaacaagagtcacctctaagatgatccagctgttgcatggtgtagcatgcctagtccttgcagcacacacgctgccattcttcttcgccgttgttaccgtattaatttagggatgatgagaaagtggcctccctttccctgttaattccttggaggaacttctgttcgaaatgaatagtcttgaaatatgtcataaagttacctatcaggaccacttttacagagatttaaatgtgataataagaataaaagaaaatgaagtgacattgaggacgtcttcttttataacagctctaggtcttgcctgttaagcacgctgtaaaatgactgttacacgtttatggattgaaatggttctgctgaaattttaagtgttaacattgttcaaattttcattactaacacctctcacattgttagaaaacagttttatgtttgacattttgatcatactaacctgggacattttatgctaaagttctcatttcatgccttaggaatcccctgcttattttgatttcagcacctttctgtaggacgccaatagcttatgtttgcacatcttaccccgatgcactctctaaaccgatcatcacagaagatattttgtagtgatgaagaaagcttaaatgtctcatttgtcagattggtttaggtagaaaataaggatttccaccccctcatcgtggttcccttttagattttcttgtttgcttttctttaaagctgctgttactcaaacgacagtccgtaaactgcactttattttttataacagctttattgagagataatttacatgctatacaattcatgcatttaaagtgtacaattcaatggctcagtctattcagagttgtgcaaccattgccacagtcagttttcttacctgaaggagaaagcctgcaccccatattttttacctcccattctccacttcaactcttccccagcctctgcgaaccgctagtctgctcttcatctccatgcgtttgtatattctggacatttctcattaatgggctcacacgatatgtggttctttgtgagtggtcctttcactttgcatgcatcatgttttcaagatactgcacctaatttttcagttccttgttttttcttacaaatacatttttcaaaatgagtaaacatatgtacaaaaatatttaatttatttaggcacgccaggtttatgagattcatctttgtagccaccaagagccactaacagtgctaacatagccaggcattctaaatgtgtttgtcaggtgcataaatctgtgactgataaaaccactgctcattacttggttcttaaactctccctcaatatagctgtagggacatgcaaaacaaaggctggctcattaataggatatgtctagagttctgctttagaaatcataatgtggacatcattgatttctctgatgctggaagctgctgctgcttcttcatctttatcttctcctccctgtgtattgagagcagggacctccttgtgctgttttgggctctccttgttcacccagattggctgcatcagcaccttcttaaaatattagtgttgctgagataggagcttttggtagatggataaactgggatttgtaaatattttgcttagtttttttcccagagttttgcagaagagaataaggtgttggtttgttataaggtggtcctttataaagtttagacctattttaataaggctgacttgggttgaagataactagagccatgactttcatcttgatggacaatgagtactcactctacttttttagtttatatttttattttagttcatttcatttaagacagcgtctgttacccaggctggagtgcagtgacatgatctcggctcactgcaacctacaccttctgggttcaagtgattctgatgtctcagcctccccagtagctgggattacaggcatgtgccaccacaccggctaattttatgcatttttagtagagacgcgtttcaccatgttagccaggctggtcttgaactcctgaattcaaatgatctgcccacctcaacctcccaaaatgctgcgattacattttaaaactctaccttttaaaaattagaacctggacaaagaggtattaaagaatgtgtctcttattaatttattatggtaatgagaagagtttggatttggacctacctaggtttttctttcctccagctccgccaccccaactccttactcatgcttcctctgtaaaatgatcactccccagtttgacaggaattgcccctggaatcccatctggtgttctaattgttaccaaatccaggcaaatcttgcctgtgatacaggtggtgaagctactggatagaactggagcatctaactggtgtgagatggtatctcattgtggttttgatttgcatttctctgatggccagtgatgatgagcattgtttcatgtgtctgttggctgcataaatgtcttcttttgagaagtgtctgatcatatccttcgcccacttgggtggatgaagctggaaaccatcattctcagcaaactgttgcaaggacaaaaaaccaaacaccgcatgttctcactcataggtgggaattgaacaatgagaacagttggacacaggaaggggaacatcacacaccggggcctgttgtggggtgcggggaggggagagggatagcattaggagatatacctaatgtaaatgacgagttaatgggtgcagcacaccaacacagcacatgtctacatatgtaacaaacctgcacgttgtgcacatgtaccctagaactgaaaatataataaaaaatacatattaaaaaaaaaaagaactggagcatcgactttcgttttcatttcaagacccgtcccccatgatcacagaggatgaaaagtctgcttaaattataagctagctaattgcttcttcagttgaagacctaaatgagttttaaagtgaaatgcatatctctaagggctaagtagccaacacaataggcaattgagataggaaagactaatttagaaaaggttgttttgttcgtttttctttttccttccctcccttcctgatttcccatcttcttcctccctcttctctcccctctcccccttctcctttccgtccttcctccttcagttccctctttcctctttttcacccttttatttaacattataaatacgatgggattgtgtctgcgcttttgttggtaattaaataaattatttatacatttaacacaatcttgaattaccaggtgatcatcttaggcactcaaaagcataagagcccttgaaagcaatatctaagcatagatattccatagcacgtcttacaatctaaatattgcttttagtgtaatcgaagcagcaagagtagtcacagcagttgatggactatttttcaaattgatttcaaaaatgtatttaaggggatgatcttctagtctagattacctattgatttttaatatgaaaagctcattatgtaagcagtaaccgcatataaaaacctagcaaacctttgcataaatcctttaattgaatttccagagcctgtggttctactttttttttaattaaatctatttctttttttaagtgttactgtgtaatttgcatgctgtgaagaggccctgtcccagataaagtgccattgatccttattaaacctcacctctgggcttgcttaaaactaactggaaaaattaaagtgttcatgccgcaatgcacttatagcttgtgtgataggattatggaaaaaataataaaactaatttccaggggagaatttctaatgtgagattttattttttttcaatttgataattaatagtgaaatcatatcatatatataaatcatattttagcctataaactgaaatggcaattaggaaagataatatatacttgatgtaaaaccatgttacgtgcggataatcttttagcactttaattttttaattgtagaaggagagaattatgaattcaagtcaaacacattaaatggtgggtttcatccaaaaaatctgattcttttactatgtactgtattagtggatttataatattagtgggaggaagtataaaagatatggaaaaagatattctggttatgttcgtgctaaaatgtgtgtattagaattaccaggggaaagaaaaatataaaagctgcaataggtttttctattttttaatacctaacatttgttattttaaaagcaataaaatcccctaaagaaatattcgtaatcaataagaacacaaaatatggaatatattaactgagttataaaaatgtttgtagtatagcacagaatgaaaaacacagcaaggtatgtacggtttaaagtgtaatcaattttgaggttgtatacaaggatataaatgataaatacaagtagtagcatttttagtaaaggctgttacaaaatactgtatttatggcctattccattctttttatagctcattaatgtagaaaacaaacacagtgtatccatcttctcagacggtttaaaattcccttaaatgatgtttttaaatgtaaataactgagctcatttgatctggttcttccttaagccaatgttagcatgaatggccatatttaccaccccggggttccttttcagactccggaaagaaaaagcgatgataatgacgtatttccctcccttccacaaaacagggccaggtgtaacacactaagaacaaatggcttggcagcctactctcctctctcgaagctccatgcccaccttgctgttgcaccccccaccccaaggaaagccttcccacctttggaagctgcattaattattccaggccacaagggtgccgttgagttactggttcactgcactggctggcaggaaagagttttaatgcaggctccaaaggtgcttaatttcctgtggtccttatgaatatgcatacagtatgtgctcagcaatctagcagttcaaactagacagctggttctggtggtgagggttttttaaatttattttttatttatttattttttctctcccctttccttggacaagccctttctgaataagctgaatctgtagtataatttcattaactcatttccagtatttaatttggttttgatatttccatcatggccccttttctcctttgattttgtcattctgtagaagttgataatctgtattatgatcaacaaggcatattgccatgactgtaggaatcaccaatttagatatccaggcttcctaaaatataagtaagtcagatttagcattactgttttcctgaatgtaggagtatttggaaaaggaaaaaaaaataaacatacatcttggaaagcagagaaaggtgttttgttttctttctgtttggattaacatattctccatcactgtgtaacttcatccaatacgtattgaatacctactatgtgtctggcaccacttcagacagtaaggatatggatatgaatttgtatcagtcaagccttccaggatcttattatctagagagaaagattaaaacatatgcaaataattttgatagaagcaaagacctaactcagcctgagaggaggttgggtttagagaatgctttcattgtaatgttttaaagctttttatttataactatagtttatttggactttatgatttaccaagtaactttagatgcaaatatggtagtactgtgaagattatggtttttgaatgaagtcactttgtggcatgatggtatagaataagatattttcatagtgaaaatggagataagacatgtcccattccctagaatagactgtcactgctctcgttgcctccaaggaggaaactgttataggaatgattgacatggaggttcatctgtagaatatggacagccctctacaaattgggaacaagggccaggacacgaaatatagtgacagcctctggcctgggagtctagacagtggtcaaaggcaggattcatggagttttccaagataagattcaagacccaaactatgaatgaaagccaggctgaggctggcaccaagtagaggcctccaataatgttgacccagcggggctgcattgttcactgccccctcctgggaaggaggaaccaatgacaatggagcatctaagagacaagagaaagggagtgtaaaggtgaggattccatggctttacactccagaaactcaggctagcttgttctcactgaagcagtcataccttctcgaaggcaactaggtggattacagaattgtgctgggtcctatggagtgtcagaaatagtgaagcttctggagcttcactgtccaatatggtagccacgtgtgactattaaaatgtaaattaattaaaattaaaagttcaattgctctgaaatagcagccacatttcaaatcttcagtagccagatgtggttattggctaccatattgggtagcaccgatatagaacatttctaccatagtagaatgctcttttggatacatctgctttaaagcattagtccccaaagtgtgaaggatgaaccacttgggttccgagaggaaacattataacttctgtttatccattaaactctttcatttattattaaacatctcaacacatttattgggtggcaggtactgttttaagtgttttgcatatatttacatgtactgtcctttcaaatattctttgaaataggactattgttgtccatatttcacagatgaggaaagagatgtgctaagaaaagaggtggcagagtagggattccagctcagtagccactttcagggtcccgtacttttcaatgtaagcatattggctctcaatttaaaaatgttattttttacagatagtacacagatgcactgacacaggtaccctctccagtcctctgatggtcaggaattgtgtgcagtatgcagtacattccaaagtcaggctggccatttccccagggagagggtccatgttggaacctttgctccttgtggactttagctttgaaatgtattgtagttttgcatgtgtgcttagttggatggattgagacatcagattatgtggtctgaactaaagcaaccgtcacagaatgaacaagagacttacaaacatttgtgcaaaaagatcagtgtttggatatagttcttagaatagcaaatagtaagaaaagagcaggattggtacttcacctactcctaataaaagcccttcatcttgtgcaaagtaaacacaatcacagtttgatcagaagtggtcaatggaaaaacaaaaatctaaattagcaaagagaaatttgaaattgcatgcattatttttaaagatgaacattgctttaacctataccattcctggaggtagtagctaatagaatgatccaagtttataatttgtaaataagtagacatcttttgaggcgtatgcccttaatttttctaactgatgaaagcgtacttccatcaactcaagacagttcaaagcagcttggagcctcttggattttaaaaagactctgtggcctctgtctctcttggttttcagtgctcagctgaggtctactctgtttatcctctgcctactagaaggatatcctttcaatagaggtgaaaatcctgaaataaaaggtttcataaatggggaaaaaagtcattgattgaaagagtcatggcatagatgctgaagttttgatgggaactttgcaggatgttcgtttgtttatcattagccctgggagagtcatccctcacctcccaccaccccttaatttaaagggatttaaaatattttcaagtacatcctgatatcagcacgtggtacactgagcctagttgatggaattgtgaaaaaaaaaaagaatgttttcccaacaatttggctgtatttgccagaactgtttcaagaatgctatgacttttgctcagggcaagggaagtgtgtgtgtgtgtgtgtgtgtgtgtgtgtgtgtgtgtgtgcgcgcgcctgcatgtgtactgtggatgtgataagagctgtgtttgtgaaaactgtgaagacataacacatatctatgaaccttttctattaatcttcttggggctggagctttaaaataaaataaataacttttctgcagagagagaacctttccttacccaaagatttcgtaactttctcacatccttggttaaggctgagctgcctagctgtctgcatttctgataggttttgctttcatacacatttcaaggacttaagaaatctgtttctaaagaataacttagaatgtgcttgttatggtcccacctattctggggaataggtggatattatacatttatttaggtggaatggtgggtcagatggcttcatgtctttttacatcacagttccacagccctcattagtgaagcagaggttgaaggaggtcacttgctttttatcccaatgtcaaataactccataattttttttattattttttgagacagagtcttgctcttttggccaggctagagtgcagtggcgcgatcttggctcactgcaacctctgtcgattctccttcctcggcctccgtagtagtcaggactacaggcatgcaccaccatagctggctaatttttgtatttttagttagacaccaggtttcaccatgttagccatgctggcctcgaactcctcacttcaggtgatctgactgccttggcctccgaaagtgctgggatgacaggcgtgagctgccttgcctagccaaataactccattatttaagaaaaattaaccagtatttattgaatacttactgggccctgtgctaagtgctttgcatgtgatttctaatttcctgaccattctatgaagtggctactataattatcctgatttcccaggcagagaaactgaggcttagagagttgaagtaatcaactgggtgttaaaaagctggtaagtggcagagcacttattggcgctaagactgtttctcaggaccttgttgtacgagagtcaacgataagacgcagaacgtatgtttcatttttcttgggaaggatctatctcactcatctgccttcctgtgtctagcaagagggccaggcacataaaatacacatggtacaatctgttaaaaggcatgaaaaagaaacagtcattcatatctgttcgtagaagtgggcgtcaagattttggggcactgagatctatgcatgttgtgggcccactttaagaaaaggagtcaaacatttagtgtggaatactggaaggggtccctagacatgaagggcctcttcaacctaccttttgttggcttcaaggttatgccatattttgcaaagtcaagttggagatggctctcgatatgcatgagtgtgttagactgcttttcttctattttttaaaaatgcacccaaatgtaaaagatacttttacctttttgatttgatgttgaaggtcatttgaaaaatactctgtctttattctttgaaatggatttactctcaagaaagttgcatgtcactttacttggaagagacgggtctcagtgaggtgtgcctccgctttcatgaaaagtctcccgtctgcagaagcattggctgacatggaagattttttttttttttaatacttttctttttgccggcatctgcgtagaatttttttttttttttttggtagtttcttaatggtctttagcaaaggaagtaagtgacactgatcggtgaaggcagacagtaagatttataatgtatttgtgctagctgattgccaacagaaccggcctttcccagtggtgctgtacgcagactcggaaaatcaatagggattaacctttgacccccttcacatacttatactgtgggctgcatcgcttaccaatatttcatctgtttcacttagctgctgttacttactcaataatgtgtggccaatctcacaagatactaattctttttttcaaatgcagcatcgcttgaagctgtgataaaatatcacacctttggaaatcaaggctcttcttgtttatttatttaactcacattaattagccttaatttaaaaaaaatgagaagagccagcatcatgatgcaagcattgactttgctcacaaaaacatcttgtggtcaacagtggggcttagggggcaggttttgtggctgtgacagaacacgtggcccctagtgtgtctgttgaaagatgggcccctttcaggaaaatggcttaccttactttttagacataatttttgttttctgttaaagggtcagttatagataagtatgctcccttgcaatgaaatgaacccactttatcaattttgaaggaatcaaaattaacttgaatacattgtctttttgcatatgtatgtagtgctttgtataaacatatgaatttgtaggagctgctcttaatgattattactgcataggctggaatagaagcaaaatttgcagtaatacttttgtacctttctctttaggccttggcatatattaaagtactatacatttgtcttaaaaattgaaattgtagattattttcatctaagacccttttgttcacagatttttttttccaagtatacctattccccagagtttacttacagtttgctattgatccagcagctggtatttgaattggtcgatatactctgtaacttgtttaagataccctacctgagctattagtttaaataatgtattcataaattgattaatcattacagtaagacttattagctgcatttatatctgcgtgttatccacaattgacttatagtctaataatcacgtatacttaagcagaagttgggttttacgttacaatttaataattatcaaggtggcaaacggtagtatttgtgtgtagaagttgagtggatgtggggctttaaaggcaggagtctctaagcaggttgctaattttacttttcctagataaaataattctctctcccaaaatgaaatacaggaagtggaccaaattgtgtcagcctgaaagaagtgattgagtttgcggaagctgtcctgaagtcgaggttctggaagatgggtggggtggggggaagcgaatgtgaagtgccattgcatttgtctccatttctgtcccagttacatcaaggctgggaggaggtctttccactggttttccgggctgtttgtgtactacacagcctgtgtacctggcaaggcacgctctgctctgccctgccttctgatgagctgactaacaccttatagatgaggttcccttagaaccaaagatgccccatgaaactccctaggatgaatgttggaagtccttccaactgggattcccagccggaaaggaaacagttcatctgactacagggtttaggtttacatgtactttaaaaaaaaaaattaataaagtttatttttacagtaattttaagttcacagcaaaactgagtgggaagtgtagagtttcatatactccctgtcctcacacatgcacagcctcctccagctatgcacattttcaatgaaactacatgttcattgaaaatgatcttttgggtggttgatgttcgattttggctctgtgttgggcctgcccagtgaggtccttttgactccctaaggaaccctgttttgggtttcttttgaggttgaagatatttcagactctttccccctcaacttccataggaaccaaactctctttcttcctcccgtttggttggaaagttattttgcctcactgcgtgatttttctactgcaccaactcccctttcaaacgttattccacaacatactaaattaatgtatactgtgttctttgggtaatggggaggggagcctgtctcacagcacgcatttgttcagctctgtgttgaaagagcactgcccgccgcgtgaaggacatctgctcacaagtgagcaattgtgcttctgatttggggcagcacctttgcttgaacgctggctccagatgaaagaacagattgccgcggagccgcttttccaaggatccctctccccagcatggggcttcatacattattgagagcaaacctactttccaccgccactcctggatgcacttattttgcgagccttattcagaatgtcagcatggatcacttggcgacaaaggcctaaagggcaagccaggaagcttccatggatacgttatttatggtgtttaattattattgtacagatttattaaatgactctgttacctaggagtccatgtagttgctgaaaagagtttgctaactttgaatcgtagatgttttatctgaaaacaaaatttccttgtgaatgctgttaccatattcctggtgtctatgtgagggggtgtgtggtggtatgccggtaagtgttgaacaacctgctctgttggcgggaactaggggaaacaaaccctgttttgtagtatttgctgattactgtggtgtaaatactcacaccttggctgatttcaagttgcagcttggaacttggagttagaaagagatgtgtagtcccataccattttatgtatgtaaagtatttgcactatgccgactaatagacataaataacctcatgagcatagataatagtcacatctactaagattattcagaagtattgagctttgagtatgttttacctttttaatatagcttattgaatcatacatttatctactttaatacttaataatgagtgtgcccaacaactaggtcttaaagttcctgatagtttagcagtgtgctctcttaagccagtcggacctggttgttgtacactactgggtgtgtttaattgacttccagttttgttttgttttgttttgttttgttttgttttgaaacagtctcactctgtcgcccaggctggagtgtagtggtgtgatctccgctcactgcagcctctgcctcctgggtttaaggaattctctgccttagcctcccgcgtagctgggattacaggtgcatgccaccatgcccagctgatttttgtattttcagttgagataagggtttactgtcttggccaggctggtcttgaactcctgacttcgtgatccactcgcctcggcctcccaaagtgctgggattacaggcatgagccaccgcccccgaccattgtctgtcaggtttaaattgcaccttgggttcgggtgaagttgatgatctattcctaatgcaggctcattcctaacagggcatccctgcacaattttccgctggggtgtgatgagctgcttcgcatcctgctaagtgtcctcgacagcgagcagacacatgtaccctgcttggtacatgccagatgattctgttgtagtgatattaaggacaacagtattttgccagaagctataacgagatgattctataacaacagcatggtgacatcagactatgttttgcaattttctttaatatttatgctggataaataatttatcttttttctcagttttttttcccttttctttttttttctccccatcttgaacatgttgctgtagacaggtgctaggtttccctgaatgactaaagcagagatttggttattttcctcccagaaaaagtagatgcatcagcagagttgagcccctgggcattatttccccaattccgtatcccatctactaatacaaactaatgagatctattaaggatgagtccacaagtttgaagggagtctcttactaatgttccgtctttgcatggtgttacaacagcgggaccattttacactgagggtttgcgagaggcatggctcccctgttatgtatttgggacttactgcagatgcttcctctggttcagggtgttgaggcttcgtgctgttaatattggaaggtgggtcatttgtactgggcatctgtcctgtatcttggagatgtttagtaacatccctgacctctagccattagataccatctctcccagtagggataataaaaacatgtctccagatgttggcaaatgtctggccttctggggagtaaaatggcccctggttggaaactagtgttccagagctacattcttagctgcttactgcatcattgtttttagccctccttttctctggcttccaggaaccaccaatcccccaacactaggatagggcataaggcaaccttatgtcaccaaattaatgtccgcctaggcaagctggactgcagaaagaaaagcagtatttctaccctaggatcattatcccaccttccccaagcttcgaaagaggtacaggagtcctcagaaatggggcttctaaaataagtggaactgggacctcttctctctcaggctgttacttgttgtggttccagcctattttctgagctgtggagcagggagggatctcacaggaaacttggtaatgtagattttggaggacttgaaaggttcctgctacctttggctggggatggagggaacatggaagatgggtctttgtttagaggaagctctttatcctggtacgctggaagttggcatagtcttagcagttagtccagatgtgaatttcaggattattctgtgagtcttccaagtcctgtctcagcagtgaaataggctcagtgtagcttatgtctaggtggctgagttcattttctagtctaggtaaagggcacctcctgtaattgaattgtgtaaaacctgcacagtggtacacctgagcccttttttaggacccaagagtgctgagattggctcttcctgagattccctctttaaggataagactttctgatttttcaactggatttaccattgtggcatctgcacatgagcagactgactgctttttggccctacctggagcctgggtcctcaggtagctgacccgagagaccgtggagctgcttgtgatatacaatgtcagtgctctgagctcattaggcgtcatctgagacagtggctgtaggggaggggaggtaggctctgagtcaagcagacctggaattttctttatgggccattaggaactgtgtgacgctggggcatctgacttcacctttctgagtcttagtttccttacctgttgaataggtctaatgatatcattatggcagatcagtgggacgattgagtcaaataacatgcccaatgcctgtttctcagagtaggctttcagtgggccacatctgttgtcactattattttgttctttctgccatttgggatgtgctttctgataatggcactaggctgccttgttgcctcctgcatgtagaacacagaacttcgcagtctctgcagagtgtctaaatcctgctctgggccagccctttcagaaacacttcaggagatcaatagttatctgcttacctttctagctgagatgagattttatgcttgttactagcagatcaatagtgaaagcaggttctgttaagttttttataggagtcattaatctccctcagcctcagtttccctatctgtgaagtgagtctaaccaggatgataatgaagagttaggtcaagtgaggttggcagccagacacccaccaccagctgtaacataagaacagatgttctctccagacccccaggtcagctgaggtcgctctgcttggaataatgaactgccacattgaggatttttttcctctctttacttggccaaatatccgagtgtggaagctctcactgtgaacctgctaacatacatttcagtgtctacaaaatgtcttttgagagaaaacagcagggacattcgtgagctcttttttttttctaaccactttcccagtgagacttcagttttcattctccccttagcagctttcaaatatgtacgtaacacaaatgttacatgtttgagcatttaaactgaatttggacagggcttctatttccagaaccttctaactctatttctttgtgacctgatagtcttgctctccagggtaaaagaagaggatggaaatggctgtggggcgcctgagctgggccctggcatgatggcaagatgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaacagttgtgggaggaggaggggtctgacagatagccggatgattttaatgtttatattccactggggtaagctctaacaaagacccatcatttcccagataaccaattcttttaaaagaacatctgttgaaactggcaatttacattcttcttaaaatacggagcgacataattaaccctctggggagactaatattagtttattagagacaatttctagttctgtttatttttaacactaaacgatttgttcagattggggaaaaaattttttttttttttttggttgtggtggcgttggcttttacttggggttgacctttccttatcaaggacgtacaaggtgaatagctgggtgataatatatggtcccatgatcatcaaccaagcaccaacggaagccttttggaagtgcacagtattgtttaacacacaaataactcagcgtttagtaactttcaggtacaatcagtctattttaaagggacctcatgtgttattcatgtatgtgcacatgtgtttatgcagttacctttgtcttcattgatttggactcctttggtgctcgtaattggtgaaattctcttgtgatcattgttgtagttcccgcaaatctatttacggttttcacaaggaggtcacgaacatgcgttgttttcaatgctgggctagtttcagacttctggcttgttgtgggacggaggagaaagaagacagggcattttgatgtggcccagagaccaaatgaaacaaacgatcctctgattgctcagatgtcctctttgacttggaaagcacccacgtgaatgttgaaccatttggccctcagttctccgtcctgcagcaaactgcattgactcctgttttctacacagtggtcttcagctacaccttaccaagcaccccttacccagcaaacgtggcttctcttccccaggcagagcagtccgttacttagactaggaaatggctccgagaagctcacccatcaccatttgctctactgcaaaacaggactcattagcaggagctcataaaatgaaactggcagtgagctcatatggaagaggcatcacgggcaactcggcttggctcaccagcccctgagctgcccccgagtgaccgctccagccttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtcagctgctacaccatgagtgcttttgtatcgtgactgtctggttacaaggtcatcttttcccctggatgagacgccccttggggaaaggaccaagttttattccctgtttaaccttggcctgacaacctaataggtgctcagtgaacagttcttgaatttaattctctccctttccccacactgatgggtatttaagctccagtggtactcgatgtgttgttttctttgttcttttttttgagacagggttttgctgtcacccaggctggagtgcagtggcagagtctctgtgcactgcagcctccgcctcccaggttcaagtgatcctcctacctcagcctcctgagtagctgggactacagttgtgcgctaccacacctggctaccgtgtcttgttttcaatgcagtatataagagggtgcattgtgtacctgtgggagtgattacagaatcccatcaaaatgggaatcactgactgaaaactggagtttatttgtaagctgggagatgggagctgaatttgaaaccccaggagaaaatagcatataaagtcattttaaataactatcatttgcagaggaggggggcacagatgcctccagtggcccaagactcccctttacacattgccgttcccttgccttctactcctcttttcattacccttatcaagattctgcagcccagggtgctgcttgttgatggacatcttcacctgactttctccctggtccaggtgcattttaagcatggaaggtgacacttgccattctcaatggacaaagggagtgggggtgtgggggtgtgctttggggttagtctctgggttttcgaaacttagcattctcagattcccagccaactggtttcacatgacaagtaaatgagcaacctggaagatgagtggcgtttccacacacagggaagcagatagttccattaggtgacagtgtgtgcacagtttatggaggatgaagcgggaaacctgagccacaaggcagtagaggttggacgagacactcattccgaaggcgggtgtgtatgtgcaaactgtataatttttttcttcttttctatctgctagcaaagtgggtaagttgacccatgacatcgtccactggagggaccacatttgtgactctagcaattaagcctcccttctcatctgtggataaaactgacctcccagtgtgctggagtcaaacatattcagcatccaatccacattggactgtttgcatgtaacgtacagaacactcattcatctacatctaggaccataacagcgagcaggagacagtccctgaccctggggactaagcccaggacctgccactaggagatattcatggaatcactgtttctcctccttttcaaagaagactgaatttatgatgaaactttcttcgtatattggctttgagaaattctgttttggtgcttatgtgctctggataattctcaatgactttcaaagttatgattcagggagtaattggttctgagagaatatgcataatcacatcaaggtgtgtttgttttccaccatttgtagccttttgacaaatttctgggggcctcatgcctgctaggccgaatacttgtgtcccttgagcctggagacggcaagtacccagtgtgcatgcatgcactcccaaagtcctttattcacgacagacatcactaatcaatcagtcatgcttagcatactactccaagtagtcattactaatcatctctagtcagcatgggagatactctttaccatcccggtaaagtgacgttttgatgaaaacagcatggatcttcctgcagagaacagactagccccctgtacagcacacaactcggggaattttaggtttggtgatttactgctgttggagcctggacttcttcctgggagaaggctcgaaaaacttcatgtcagttacttaatggaataatacatgtttcctgcttccattgtcttcctggacctgacactcactctttaaccataagcagaagacacatacacaaatgtcctatgttaagaatctttatttaagacaggtggctagcattatttgggtccagaagcttccctggaaagaaaggattcactgcaagatcgacaggcttacccagttcatttaggcgtggcttgatttatgcacacaaagctttgggaacatatcagtcacatcaagctaggtccacctgtgtgagtaactaacgtgtttatttatgattttctttaacagcacagaagagcaattgcatttggtcattctagtatcaactgagttctttataaaatatctttggggtgtttaaggagaattattctttttacaagttctgattaatgacaccgcaaaaatgaaaataatgagctaatatgtatctagtacttgctatgcacttatatgtatagaagcgtataatccacagcactccttctgaatacgttacgtaaatggaaccctcgcaacagtcttacccccattgtagagatgagaaaactgaggcatacagaagagatggaactaggccaagagcatagaggtggaattgttgtgtgagcctgtagagtccgtgttcttacccactgcatgatgtctgatcatcgtcaattttctttccatttggatagatgaatggtaatacttccctactaggtagagcaatgattccagaagtttataataattggaaagtgtattagtcgattctcacactgctataaagacattcctgagactgggaaatttataaagaagggaggtttagttggctcgtggttctgcagactgtataggcttctgcctctcgggaggcctcaggaaacttacagttatggcagaaggtgaaggggaagcaggtaatgtcttcacatggctggcagtggaggaagagagaaagtagggaggtgctagatgcttttaaacaaacagatctcaggagaactctttcacaagacagcactagggggatggtgattagaaagcacctcatgatcccgtctagttcctgcagagaacagattagccccctatgcagcacacacctttgtgaggtcccttctccaacacagggattacaattcaacctgagacgtgggtggggacacagagccaaaccacactggaaggtaaaaaagttggcaaccagaggcttagaggaggttcaaatctcaaagtgatgtctttccttttgcattttggatggtttaataaataagattgatacaaacacaagcattaagcaaacaaaaggaaataaaaacggcaacaaataaaacttctgtgctttttgaaattctgtttttggcaggcaacattccaaagatctttttcatttaaagtccaggagtcttctgtgtgaaccccacacaggtaccttggaaagactgcatctcctggattttgcatggttctggcttaatggacaacatatcagtcattttttgaggaaaataaatttaaggcttggtcatcggtccttgagtcagcacattgagcgttttgtcaattagctcctccccccatctttatggtatggcttttcctgtaattacagtcaagatcctatagccggaggaaggcctgtcaattgagtaagaggctgatgttcatcgcacagtgacagcccattcggagggttttaggcctgtccttagagaggcttgttatttcctctttcggtactttgttgcaacccagctcaccgccatcagatgagtggaggtttcttatgctgtggcgaaacccagggggtcaagcccctcggacatgacgtactgcaaagtgaggatgtttcattgatttatatttttaaaattaaaaataattatttaagctgcatctgtgtgcttataagaaaagatatagaaagattagtagtagactgttgtgttcttttttttttttttgagatagactcttgcctgtcgcccaggttgcagtgcggtggcatgatctcggctcactgcaacttttgcctcctagattcaagcgattctcctgcctcagccttctgagtagctgggattacaggcgcccgccaccacacccagctaatttttgtatttttagtatagacggggtttcaccatgttagccaggctggtctcgaactcttgacctcaggtgatctgcccgccttggcctcccaaagtgctgggattacaggcgtgagccactgcacctggccagtagtagacttttgatagggttttttttctcaaggtgtagatttggctaggaagtcatagaaaatggtctttttttttttttttggagatggagtctcactttgtcacctaggctggagtgcagtggtgtgatctcagctcactgcaacctccacctcctgggttcaagtgactctcttgcctcaacctcccgagtagctgggactacaggccaacgccacggcacctggctaatttttgtatttttagtagagccggggtttcaccatgttggccagggtggtctcgaactcctgacctcaaatgattccctgcctccacctcccaaagtgctgggattataggtgtgggccactgtgcccggccaggaagatggtcatgttttactttgaaccaatctgtgcttggtttatttttttcagtgagtgtggattacgtttataattttcggttactagttaggtaaagaataaaaattaataaacacatttatagttctcagagattccttgagagaggaacatctttaaacggataaccacagtcttctaaacacctgaaagggtgtcttttgctgaactatggagttttagttttgctttagaatttttggatgattagacttgtacttcttttaggctatttttccacctggtactatttggctttactgactgccctcattccccatacaccaccttgttttgttcagattcccctaaatcttcattctcgtcccacctccccatcactcctgactacttgaaacacgacttctgtcctcagaaggcagcagtgttccctcctcccgttcatttttcattttcccgttgcttaaaaaaatcaagcatatgtttgcagtcatcactgatgttctgcctcctcttctaaagttatagatgagtgccaagttggcagagcatgtagaaagatcactgcagatgtccttgtcgtgttgaccttattggagaatttcctatctgtgatgacctgtaaatggaatttaagggaggaatcaaacgtgttagcacggggttggcattgcgtggctgttttcaattaacttgaccactatgataacatcaaaggtgtgtgtaccattctatgaccattgaatctccatggacatgttttgggaaatggatttgtcccattacactgctttctttagtgcataagatcttgaagggagggatgcattctatgcaccccaagtttctggtttactcgtggtttcaggtgtccctttagacaacatcactgacaactcactatgtaaaaccaaacaaattattagctttcttactgtgtgtttgcatttgctgtgcccagggaaatgggaagtgcattgaggaagaggccccaagacatggagaagtcactccaactttccggaaaccccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggcaaagatgttagtaatgggaaactttggaggaaggcaaagtcagaaattattctgcagggagatttggggatgttggatgctaaggcccaagccgtctattgtatgccttttgctttggcataaaacaacagatgaccttctgttaggtgtatgtctgctcatgcttgagagtggtggtgtttggaaagactcaatagcatatgcacatgaggaagttgaccaaatgattccacagcacatactcatttttttgctctgattctagcttttcctccaattttattcagaatttgttcttttcttacctcacaccatatagaaaaatcaactcaaagtggattggagacttaaacataagatctgacagtgtaaaattagtagaagaaaacaaggaggaaagctccatgacactggtctgcacaatgagtgtttttgtatatgaaccgaaaaacaggtagcaaaagcaaaaatagacaactgggattacaacaatctaaaaaatttctttacagaaaggaagcaatgaacagagtgaagcagcatcctacagaaagagaatatttgcaaaccacacatgtgataaggggttaatattcaaaatgtacacacagcgtaaatgcaagaaaagaatctgatgtaaaaatggcccttccaacatctagcattattgtgtgttgaataaatacttgtttgattaggtctaatcactcttcatgattggatttccaaaatgtggactctcagcaggacattacagggacagtggttgggtctggagatgtcacccttagctgtttttcacaatgagaggttgttttatcataaataaatcaataaatggtagattatacaccggagttactgagaattataaaaaaattaaaaaagcccacattttaaagggaatttggtatttttaacaaagcatcagggggctgggagcagtagctcacgcctgtaatgacagcactttgggaggccgaggtgggcggatcacaagatcgggagatcgagaccatcctggctaacatggtgaaatgctgtctctactaaaaatacaaaaagaaattagctgtgcgtggtggcgggcgcctgtagtcccagctacttgggaggctgaggcaggagaatggcatgaacatgggaggtggagcttgcagtgagccgagattgtgccactgcactccagcctgggcaacagagcaagactccatctcaaaaaaaaaaaaaagaaaaaaaagcatcagggttgtcaccatgaagcaggaggagaaaaataatgctgttagacttcttaaagcgtattttgtggtttattttattgctctgtaaattgcaggctgtaattcatggggctcaggccagtgatttcacagttgatagaccaggcacatctcttcccaccccttccccacctaggggcaaggttttcaggaagagccccttttctaaaccacacatggcctgctcacaaatcttatgataaaactctacccactgagaagcacaaggtgtgaggctattgatgaggagttgaaggtgacagagaccgagaaagtgctgcacacctttggcctaaagggtaatgagcaacacacaaggattgggagatgttcatggcaagaaaaattcagaagggacattgttgtttcactaattctgtaaaggagagcagcggcatttacttaggccgattccccattctctctttctgtttttaaacagagacagatcttgctctgttgcccaggctggagtgcagtggcatgatggcatgatcatagttcactataatctcgaactcctggtttcaagtagtcttcctgccttggcctcccaaaatgctaggaatacaggcaggagccactgttactggtctgttttttttccttaaatacataggcaacttcctcgattgtctctcctttattggcattgagagataagcacaataatgattgttaagatggaatattatgaaggctcaaggaatacttctgaaggctttttgtctatgaagtacacgaggtttcttaatagtttggcctctggcaaaaatggttttattgtagtttcatccttgttgagtcaataattaactgagtttgattaaagctgaattttcctaagtatgaaaaccatgtgggcccttctctttcctcgtgatgcacggtgatagtgcgtatctaacacttgaaggtgtccacgctggccctagctcagtgagatggctttgctttgggggggtgagggggcggaggtggtggaaaggcagcaagctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttcactttttaccatagctaacctttctaagtggtcaggtgggactcatggagattttccgttctttggcaactagcagcgactgcagattactcatcagctgtctccttgagtccacaatgccgggcggtggacgggcttcctgcctcctggcccagggcccctttgccggctcttagtgtagagcactagttgtaccatctggtagttgtttgtgcctgcgactctcttccctattaggctttgactccttaaggataagaaccatgtcttattttttttaatctgtagctccagtatccagcccaggacttgacaccagcctctgtcaaatacatccgtggaacgcatttgtaagaaatcgaggccaaggcactggaagtcccattgtctctggatgctgagaccttgaatttcatgccatggacccctcccttacattccgtctttaatgtgctataaatagacattcctggccttgcctaaataggattaagtagtaccaaatggtccttaccgttctgaggcctcactgagactcattttgaatctttaaagaaagcagtagagggatggagaagaagtgggtcaaaacctggtttctgcctgtgggaaaatacaaaacaacacaacagcaaagcagactagcatggttcaaagcacacattgaggtttttggtgtgccattctaatgcatgagctcattttgagccaaggatagctttttggtgtagaattttgccagtcctacggtcaatgcagtactaattgtgtgtgtgactttgtgcagtggggaaaggtggggctttaaaataaaacagaaggtatgaattgcttggcatttgctgtggttcctaagtctccattccgcttgccaagattaaattgaattattcccgctgccattcagttttactctgcacaaaatacagccaacatttttgcatttctttcttccttcctccttttcttctttccttccttccttcctttttcccttcatctatctttgttccgcttttgtttgtttttttttagatcgctgcatgctgccgcgttgggttaaccatggtagcattttaccatgagaagccatagcaagatgtgccaggtgcatgctgctggaacacctggctgaggctccaacagcattttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgcctgtgctgggcctgctaggagtcgatattttctggctcaaagaagttccaaaagaattcaaagccagtgtgtctctttctctggacggccaagtgatgcaggtaccacgcttaggtctgctggtgtttagcttgacttaaaacccagccagggaaatatgtttcactttgctggggtgcaggtggaggaggctattattcttaggcatttaacagtgaagaatgttgggcagggcagagggtcagctgaatggcagggattccaggtctcagttaatgcccacaaatttctgaactttgaacataaataccctcactgcaatacatgtttttctttctctctctttctttctctttttttttttttgaaaaacttttttggagcagcacctgcatgttgtaaaaacacaaaataaaaaaaaaataaataaaagcagaccccttggttcagatatctttgtttgtgtaaatgttttggcattctttatgaaaatcttcagattttcaagagcttaagatgacctcctctagccggctgcagcagtgtctaggtatctgtgaatgtgtaagaaattgagacagcctgcaaaatagctcacccagcttttctttaaagttccaacctttttgctggctctctttcaaactgtactgctcactttgggctgtacgttagaaccacctgagaagttctttttctttcttttttttttttgagatggagtcttcctctgtcacccaggctggagtgcagtggtgggatcttggctcactgcaacctctgtctcctggcttcacgccattctcctgcctcagccttccgagtaactaggattacaggcatccgccaccatgcttgggtaatttttgtacttttattagagacagagtttcaccatgttggccaggctggtctcgaactcctgacctgaagtgatccacccacctcagcctcccaaactgctggaatctgagaagttacgtgaaactagcgatgccctgggctaatgaaatcaggctccatggtggggaaggatgttgcggtggggttggggtggcaatgaaaggtgaaaaccactgtggtcccacctgcccatcgtcagatttcggttcctctcagagttaacgtagaaggtttctgggggcatggacctgagtcttatcccctttgcaaaagtaagaattgtatcgtagcctgactcagggttttagccaacttctctggatgctaatgctattctcttctttatacttgtcttccttcccaggcacacatccactggagctttgcagggcctatctgcccttagccctccaatatccttttcattttctttaatagttttattgatatataatgtgcctaccatataattcatctgcttaaggtgtacaattcaatggcttttagtgtattcagagtttgcatccaccatcacaatcagttttagaacattttcattaacccaagaaaatgaccccttagtcatcaccccaaatacctcctctctccagttcctggcaaccactaaccaatctacttgctgtttctatggatttacctattctgcgtacctcatataaatagagtgatatgttagtcgtctcttgtgtctggtttcttcctcttagcatcatgttttgaaagtttatccctgcgacagcatctaccagttcatcatttctttttgtggctaagtaatacgccattgtatggatataccacattttgtgtatccattcattagttcatggattttgtgtctattatgaataatgctgccatgagcatctgtgttgtccacaagtttcagcatggacttctgttttcattccaatatcctttgatgacatgtcttggcagtgatgtctatgacactgggcaagtgtcttaaaatgttgtgcatcagaaaaaagtcatcattgccaaggccagcagatctcgaaaagggggctgggatacgttggtgatttttttcatgctctacttacagtatgactcgtaactgttaatggctgagctcctccttaggtgaagaaggaaggcaatggcgttttctattctgggcctccctgcttccagcgatagcaaggagcgaaatgagatgctgtctaagaaaggaaggtgctgcgatctttgattactacacagcctcggcagtgtttgtatgattaatgagtccatgtttcagacgttcccatttaatgtatttgagccttctaacaacattgcctttcatatgttgctgactgtttttgagatttatgaggcctaactcgcaagcgatgtgtgtctggattaagagaacctgagaatctctatttatgtctgaccccaggaaattccctttaagctgcttatcagaggtgcatgctgagagcatgatgggaagatggagtcttccatccgctggtaaaatctggaatctgctctcatttcattttcactgaactgaaaataaggtaacagaccctcaggtctacctataagtaccttccaactgttccacttttgtaaatttagttcagataatacatatgctgaaattcctatatcccccccatactccagatcttcagtgtggaatttaaatataattccttattgtaaaaaaaaaaaatttttttttgatcaaggtgattttgataaactaaatgcatctttaattttactcacagcaaagcgattctttattttctctctaaaagcataattgatgtgccatgatctttgtctttgcatttttaaaactgaaagaacatttccacaccattagaaataagatttcttcttaaaaatattcacaaggtgcaaacacttacatgtgtatatgcatgatttcaccaccagggggcattgtggtttgactgtccagttaaagagcctgtgttctatcagtttacccagaaactagaaggcctgcgagtatttctgattccttccaagaaggattcatatctggaagagaacagatgtcgactctttttcctctctagcaaacagtagtgttgtcaaatttgctaaacttagccagttgaagattaacatgcaatatataatatgcatgcgactaagtgtacaataaatagtaaatcacatttttatgctttctctgaacttggaagctgcaagttatgttttttttattccctgggtgtgatgaaataaataacattcaaatacatcttaaagatgtcagtcagggggaaaaaagtgcttggcaactgtgtttgatagatttcttttatgattaattctcctattaagttttaatgacttcaaagatacaaagctagaaactacaaaactaggcatggttaataaataactgaaataccaggtgtatagaaatgcatctgtggaaaaatgaaatcatgtattctctaggatatattaggaaatggctctttggcaagtctagagggtaaagtatccctgaagggggaaaaggtttaaaaacagtaaactaaagaagattgtttttctgaaagaaattcccaggagaaaggtactttctgagattcacatatgtagattacattgttatgaaccaacatttataagcaagcttgatctctcagaatgcgtttgtctatctcagattttcaagaatcctcatacaaattgtccagggtttccacctcgcagttttcttccagggttgctatggcatggaaagtacattgctattttgttatgtaaatgctcaacagactggctcattccagaagtgggcgtcgtgatgccagtgtcttcgtaatactatctttctttcccctttagcacccagaacttatgaaatatgactcggtttatcctgaacacatctctgtgcatcggggaggatgggagaattaattccagtttctcaattgcaaaagtgaggctggtcatggggcttggaaccacgccacggacgcatgaagcctccccgtttacatgccaaatccagagcttatgcatccgtgctcagggctctctgtggtaggcaacagctggattatttactttctagaatatctcgagttcttaatctgagcagtttcgaaaccaaacccacattaattaatataaataatgactgggaaacgttgcaggactccccggaaaagaatgtataaattgatgtgtttttgtatatgcttatgtatatgcctttgtgcacgaaaggagataaatggtgtatttcacacagttccttctcctcctctaagggatattattgttcctgaatttttctgagccgccgaagcacaatagggtttagagcgttcacaccaggcagcccccactcttcagaacttcaaatctaaagatcttttaaatacacagaacttacttttgaaagctgtggcccatcccaaatgaattctaatcgtcagcctctagaatgcctggagtgagaaaacagaatattgttcttttctgtttatattatttcatactgagttaatacacttgccaagactccgaggcagcttctggcttgacaatgccttctttaactagcctagtttctagaataaagttcgggtccaccaggccctctgagtggggctcaggacactctgagatggaagagactggagaaagccaatctgtttctccctgaaaatcatcttacttttttaacgcttcgtacctagatttggcctgggcagcccagggagactgttcaagcactggatacctagactctgctgggctctagagaagtgctgggctacagcgcccagtgccctacctcttggggccagccagcctcaccaaaaaatcacgcttctggcttgctccaaactcaggaagttgctgggaagtctggctagcaacaccctcattcccagtcctggccatgcctctctgctctccctagcacagggagcatgcaggcttaaggctggaagaaaccccaagcatttggccaggaagaggcaactagttccagctggcccacatactacactttaaaaattacccagatgatctgattctgtagagagagtgggtggagaggactccagggccatggaggaagattcggcctttctctccctaatcatgagcaatgtgatttggagagagaaggacccggttggctctgcaaaccgcatttccttggctgaacgccagaggagagaaatgatccggcaagaagacacaccattccccgtcagccccttcccgacccttgcacccctggatcttctgctgagtatcggattggtctgcgtccaagagctcctcgcttggccagcaggggctgcctggagaaggggaggacaggcttcgagttttttgggtagtgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagtgacttagccactctataaaaatgaagagcagagctcgagtgcttataacacgtcatttttacccaagacagagaagaaaaacgaaagagagcctgagcattcctttgactccctccacccccggaaggtatattcagagtctccaagactgcctccgcccactcacatgtttatggcccggtgagaccgcatcctccctttctatatctgtcccttttctggatgcagggacacagaatcccctaagtgggaagagctttggagtggaggctgttcaaagttctgtggtgattaattattacctacccaaggtctggtcattgctatacttgagttcttttcaggctcaagatctctacctttttgtgtgtttttttttttttttttttttttttttttttttgtacagagtcttgctctgttgtccaggctgtagtgcagtggaacaatctctgtatgctccctgcaacctctggctccaggtttaagtgattctcctgcctcagcctcccaagtagctggaactacaggcacctaccaccacgcctggctaattttttgtatttttagtagagacgggatttcaccatgttggccatattggtcttgaactcctgacctcaagtgatcctcccacctcagctgcccagggtgctgggatcacaggcgtgagccaccgtgcacgacctcagggtcccttctaacctgtgctgttgtcataaaccctggaggagaagcaagatctttctagcaggagcaacatcatcccaaataaagtgatagactttgatagtgttcttctattcattcaaccaacagagaacaaatgaaaagaatcaggagtctattgaggagacagaacatgagtgatttctgtgtgctgactatatttaaagacaagattagcagtaatatataaacgtaaataagaatttttttccccagccaagaaccatagattggacttcacattcaaaatgtaaattgtgcctaggaaacatcaatgcttattttaagcaactgacccttgggataaaaataaaaagtcaaaaggaaacaaacaatgttgctgagaagtgatagaatattctagtttatatctcagtcattttacagctctggcatttctgggtaacactttagaatacttccactccggttggtccataaaaagctgcctgtgtttttatgttttgaaaatacacgcagagagacccactgcatgtcctattaggcatcttatccttgagtaagcaggcatgcaacatcagtgtcacacacatatcacccccatactcgacattctttgagaaatgccttggtcccgtctccagccagatcagcattgcacctcttggcatgcgttcttacctgttgaggatttgcttgaattataatatggtagaggaggaaacacagtcttactgtgccgtgtgctgagcgcagagccattctcagcatcctgccttgattaataaggcgtgaaagatcctccgaattcgcacctgttcagacaagcttgtccaacccatggcccccgggtcgcatgtggcccaggacagctttgaatgtggccccatacgtatttgtaaactttcttagaacatcaggatttttatgcacggaccttttatgcatggactgtggtgttttttgatttttggttgcgtgcgtgtgtgtgtgtgtgtgtgtgtgtgtgtgtgacggagtcttgctctgtcactcaggctggagtgtagtggcatgatcttagctcactgcatcctctgcctcccaggttcaagcaattctccgtgtctcaatctccctagtagttgagattacaggtgcccaccaccaagctttgctaatttttgtatttttttagtagagacagggtttcgccatgttggccgggctggtcttgaactcctgatctcaggtgatcctcctgcctcagccacccaaagtgctgggattataggcgtgagccactgcgcccggccttttttttttttttttttttttttttttttaacgctcatcagctattgttagtgttagtgtagtttatgcgtggccgaagacaattcttcctccactgtggcccagggaagctaaaagattggacacctgtaaacaaaaacaacacagccatctagctgcaagacgtagctaattgctctgcagaacagggttggccagcctggccttgatgtcggagtgttctctagacctcacacccagtccctattcttaggttttatttctcaaaccaggttttgcctgagaaattacagcaaatgattcagagcacaatgatgttgctcatttttgataagtagttgaaagctgatggtgccctccatttcaaagcaacagaagaaacgctggtggtcatggagaaagagttgggaagcagagcgtgaatgccgggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgcgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaaaagttagccgagcgtgatggccagcacctgtagtcctagctacttaggtagctgaggcaggaactcgcttgaacccgggaggcggaggctgcagtgagctgagtttgcaccactgcattccagcattggtgacagagcgagactcagtctcaaaaaaaaaaaaataatataataataataataatcgcacctcaatactccgtagccattttaccgcatgtgactattagctgtgcttttgcggttatctacgtctgttgtgtctatacggtggagtatttgcagacgctctgccagtgtgcaatgcttcccagccctgcattcagggataccaacttgggtgctgaaaagcagcgatggcaggactatttacaccacggaaacaggcaaaaactactgatcaagccttcactgttttgtttatattgtcttgacttagaaagtgattgcaatgttaataatgcagattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctctttaaaaaaaaaaaaaaaaagaaagaaaaattagctggcatggtggcacatgcctgtagtcccagcttctggggatgctgcagcgagccatgattgtgccactgctctctggcctgggcaacaaagagagatcctgtctccaagtctgtctgtctgtctgtctgtctgtctgtctgtctctctcggaaatattccttcagtgtattagtaaagaagttacttaggagtcacttatgcccttgaagagtgagtgatgtatcaaaatatgtctgtctttattgtttcactttcatccttctttttttggagatggagtcttgctctgttgaccatgctagaggtggcgcgatctccactcaccgcaagctccgcctcctgagttcaactgattctcctgcctccgcttcccaagtacctgggattatagacacccaccaccatgcacagctaatttttgtatttttagtagagatggagtttcacccttttgattggttggccagtatggtctcaaactcctgacctcaagtgatccacctgcctcacctcccaaagtgctgggattacagtcgtgagccaccgtgccggccactttcatctttctgattaactgaaaagtatcaagcaatacttacatgtaactgcactttctcatcaactgcaaccataatttagctatggatacaagagttgggcacaaatccatgaaagcattgagtgagaatcaattggctctgtgggatttacaataaagaatgttgtttatttttatttgtaaattgtgtgctacagatccttcgtatcagtaaaatgtatgataaacatatgtgtgtatattcacacacaccctttcattttggcaggagtgtttgttaaacatttaccacagcagtggattcacttccatcagctgctaactttcaaggatgtttgaggatgcatgacctgtgcaatgcacctgcttcggtgcctggcacagagtcgcaaagccacaaagatggtgcttgttggttgtatgtgttgtttccatctgatatcaccattgaggggagcaagatgacatgtgcctaccccacgtgtccagcagcaaagccacctggcatagtgggctgctcagcgtgcctggttcatactgcgtgtttatagtcccagggtgttttcagagagcaaaagtcctttatgattagcaaattgcaggtcctcccctttctgatatttacagcccttgcaaccgcctgtacaaaaatcgggaaaaggcagaagacggctgtcattaatgtaaaagcagctggttacctccccctccccagcgcacacatcacctcctagtacaattagtcaccatgtcttttcccttccgtcaagccttttagcggagttcacagggatgccttcggtccagacactatgaccgttgacgaaggatttgaaatattttgagaactctgaaataatgcacaccagaaacgtccagctgaaaacaaaaagggaacaagatgacattttgcaatcccatgcacgttgcaggcacgttgaatgtgaaggtcagtagtacttcagagggcaggcctgttgcccccaagcctgttgcctaagaaatgcccaggccctttgaacaaaatggattcgagtgattacagcacgtcctcacttacatctcccaatatatttcttgttattctcgttgagtactgcattcagacagaggttgccaataaagtttattgtaggagctaagtgtcaatatctgtagtaccccccgcctagggtgctgctaataaaatgccacagatagtctgggagaggcatgaaaatttgatggcaaattgatttcaggttcatcttgaaatttgtcctcagctggactcgatacttctggcagacatgggatggcttttgtcagaagggtctgctggaatgagacagagatgtcttgatctgaatattaaatacaacatgctgtttatgacattatccgtttactgctaaaatacccagctacttctgtttacacattcttctgcgttgaatgggtaagatagcatctcatagatccactttacatatgaaaagaagttgtatcaaacttgctgggcatcagaaataaagggttttagagacactggcttcaaacacaagttattccatccaagattctaaacttagcaatgcaacttgcacttaattttaaaacgctggaaaaataatgataaagattgtgtgatcaagtatagcagccctgtggtgtttcctcagaatggtgtattacagaaaaggaaaaagccatatacatggagaagaaactcccgatatttaatattatcaattgctggttcctgtaaatttgcatttatggatcacattataaaagcaattactcttatggattgttcatgcagaaatgcactatgatgataatatacttttaaaagtatatttatttccagaattcaatttgtaagaggtttgagggaaaaataatactgagttttgagtgtttctgattttaaaaatgtgttgagtagaattaaacgtgttcaccaaaacccattttatcactttaaattattgggcaattaattgtatttacttagcattgaatgcatgattagaaatggaatttttaaaaaagcaatactcaagtggagtgagttcatttgttcattcagcaaataggacttgagtcccctactatgtgcggagccttaaaggatgagaaagatttctgggtgggacttcaatgagactcatttcgcaggttttcatgttattatgtatatgtggtaaataattaattttttcacaagtacttgcactagtgatgctaaaataagcttgactggcttgtaaatcaatgaaggttactgttgcattgctttgaaattgaatttaaaaacagaaacagagcagtccctttgcttccgaatgcagccctcccattggaatcactttggaagaatctggatctgcgtgttacccagtcttacttttcaggcagtcccaggcaggaaggcccattagtgaaaagagccctgcatatgctgtgggtcatcacagctgctgctttgcacatttaggagatatttgtggacctttcattaggacaatttttatggcccgagattaaaagttaaagttaagtagtaaacgtaatgaacatgtgcctttggagattccaactggtttgtattttcattctctccgttggtcatggcccattgaattttgatgatagcattaaaacaaatgcctcaaatcatttttggaaggagacaggatatgaattgacaaattaataaaataaattatacttcaaagatgctaaattatctcttctatgtaagtaggaggctctcttttcagatgtggaatttgtaggagcttgaatattctcaagagagggtatgggcaacatttgataaaagatgtaattattgggtcgtaggaaataatgattgagatagggtatccactgccctggtgggggaatcagtgaggctaggaatcactggaaaatgacattccttgagactccttcaatgggtagagtttgctttagcttttcatgtatcttactgtatgatggttgcttttgggttgaattccaccttgggttcaattcaacatgaaagttaaccttttggtgaaggaatgatccaggggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaaggggagcgaatagtattttccaaacttacgtcaccacttaccatccacctgcatactttacacgtcttggaatcaaccttacagggaacacttggtcgaaaaacagtgttttctaaatttatattacagttcccactccccccccccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaagactttctctatagaggcttcagacgtcagaaaaaaacttagagagtgactttcagatacagcaacctagtctatgttatagaacattctaaaaagagcagattttaatatctttcctcccacacttgctttgactccctcctttagtaattagataattatgtataataagcacattaattatgtgcaacagctgccattgagtgtgtgcatgtacaactgcttgaaaacagcttgtgagttcactattaggtccatgaaatttttctccttggcaggttttcactattagtttgcttgacaaaggatagatacattttccatgtgtggaggtaaaagcagtgcagtgagctaaaaagttagcaaaggtgaagtggtcctaatctgcggccctggtacacttagataggcatcattgcctttcctctgagctcttggtgctgataacagcttccttgaccgataagtgtaccagatttccttacctgtcccagggcaagatagcaagagtttcttgatgcatttaaaaaatgcatttagtgttggcaaaaggctggcaatttattattaagtggaataagcagtttaaaaacagtatgtacagggtggttttctggctatataaacacacaggcattgaaaatagatatacataaataatgttactataatttgtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagtctggccagtgtggcaaaaccccacctctactaaaaatacaaaaaaaaattagctgaacctggtggttcacgcctgtaattgcagctactcaggaggctgaggcaggagaatcacttgaacccgggaggcggaggttacagtgaaccgagatcgtgtcactgcactccagcctaggcgacagagcgagaccctgtctcagaaacagaaaataaaacaaacaaaaaaatactattccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcatttccccggaagtgtgcaagaagaggtaggtgacttgcatgttgtctatgaacgtttttagaaacgtctggtggaaccatccgggcatcacatagctatctctgtgcagagccaggccggatgcctaggtgagatggaaagcttccgtcagctttcttgccggcctctcctcgcagccgctcccttccacacctgccttttcacctgccagactgcgcgttgcccgttgccctaggtctgcgtgttcagcacttctgcaacagtttcttctgcaaaggtaacttagcggagggtacagggtcttcttccaataagtcagcaccttcagttaaaaaaagcaataacattctccaatcttggcagtctggcaaggtagaaagacacctgaaggtgaacatctttggcccatgtgaaattttgttacgtgttgttaggtttcatttgtctctcagtcaatcagtcaatcaatcagtctctctccttccatccccccttgtcccccttttctcttctctccccttccctgctccctctctttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggagggtttgctgttggcttttacaagaacactgtcctgttatgcctgctgctctttgcttggttttccctggacggtcacaaacatacctccaggtcaacagttaaagagagaacccacttcttctaatagttgtgtaatattccatactacagatattctgttatttatggtagctagatttctattcatttttaattcccatgctcagagctttccagacatttggaaacattttagaaaattgacatcatctcttcaaatatctgaactcagatttcctctgtgatgttggaatctttaaaatatcatgcatacttggcctgtttctacaattttgttccccagccatcgttctccattttgcacgtgtattgtctcctcctattcctctgtacccttcacacgtgcctgcagggtatatacttttgcacaggcaaaagtccagctgaaatgatccttacttagcataatttaaacgcgagggtttcctaatgctccttccatttaaataattcaaaaatccgtggcaaggtacctgaaaactactaagagaagagaggtgttaatggacacatcattgaggctgaagccaaactgtgtgattctgtctgcagttgagaactgtaagaaaaagatcaagattaacattattattattggtgttacctcatgtctgtacctttttggagacttgggtctgtttcccgagaaatcatttttcctcctccttgaaaatagtgaatttcaagtggttttaattttaactgcattatttgtttgctttatatagtttttaaagttttatgaaaaagtcttccatgtgttttttatttatgaaatcggggcagccatccttcaaatatgaagcaggtatctgagaatactaaaatcttacagtgcattttataggagtgtgaatgatttttctgcaattgacatatcaaggagcttatcatctattattaagttaccttttcctgaaacaaaatatttgtcagatgtaacttggtacccaaatgccttttcttgctaaactaggaactgtcacacacacccacccacccacccctttattcttggttctctcctatattttgacatttgaagcatccacagaaaagtaatagaatgagcaattgaaaatcaccagaactgaaattatttccagctatgtttaaatatgaatgtcttgttcgacgcttcgcatatgtatttatggctgtgtgatatcattatggcatcctaatgaatgtctactgaattatgtgggattcaacaggggatacaaatggatttgaattctgtaactgtcatattgtggtccggagagggtggaaactgaagtatccctctgcgtcgccacatctgtcaaaagtcctcagcgctccccgcaatccatgtctggtggaagcgcgaggtggtgaggatggaaagggcatgcgttgacttcatgttgggacgggtcttaaactaaacacatgtcacgttatggagctgtttaccttggctttgaggtttatttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggactgaaaagagaagtaacagtccttggtttgtattccagcccccaccttcctatgtctttgagcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttattattattattaatgttattttttgtttgtttgttttttgagatggagtcttgctctgtcacccaggctgaagtgcagtggcgtgatctcaactcaccgcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttataattttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctagtttttgtttagctgtttttctaatttaatcttatacatgagacagctatagatggatgtatagtctttgaagtggggccagttggctccgtctattagctgtgtggcttttgtgcaggtgacttgtggcccccggcctcagggatctcatctctaaaacgaggctcttgatgttacctgccttacccagctgtgaagattaaaagggttttgtgtgttaaaggacttgcggagtgcctagaacccaatgagggccacagagcttgctccgattgctttcctgaaggcagtaagcatgttgctctggtaatagtcatcttcacggccatcattttgatcacattttggcttagtttcttcctctaccctcttcccacgtcagacctttccatggaaggtaaaacatgttaacagtctaatgtgtttccttctaatttttttcttcatttatattatacatctatgaaatatatatatatatattacatatggatatatagacatacacagatgcatatttagggtgtgctatggttagaaagtttgcatccccccaaaattcacaggttaaaatcctaatcctcaaggtcgtgacggtactacaaagcaggacctttaggacatgataaggtcctgggggcggagggtactaatccccatgaatgggtttagtgcctttataaaacagacccaagagagaccgttatccattttaccatgtgaggagcccacaagcaggtgccatctatgagccagagtggacccttacccaacaccacatctactggcccctttatcttgaacttccagcccccagaactgtgagaaataaatttgttactcataagccacctaagttatactattttgggatcgcagcgtgaatggactaaaggtttttgagattcttttttcagtagtttcacctaataaaacatggaatcattctacgcatgctgttctgtattgtagtatggttttccacactgagaacatactgtgaccatgcagtcatttcccagatggaacttattgagggacattcacttagtttcgaaaggtttctccctccactcccatcccggccacagatagtgatgcaataacatccttgttcgcatgtccagtctgaagcttttattcctatgggatgagttcccaggcataggattgccaggctggactctaaattttgaaaatggatttttatcattctgatggattacggtgaagagagccaaagtcttgatagaaacactcaacgcagtgaattttttagatgtaaaagtggatggtacttaaggatacgcacattagaaggagtaatttgaccagcccatcacagtattaattgattttcatgtctcgaagacttctgatttcgttttcgaggctggaaaggcaggtggaaagcccatcagttttacacacatattttgcagacaagtattagaaagtaactagcctgcttttactaatggttctgtggaagaaacacagcttgaataaatgtcgtcttggatgctcagcacagattggcagtggatgtcaggattgtctggtgggaaggctgctgggactcactctagactgggagtggggtggggtggggcagggcaggacggccctggctgattaataatgtttgttatgaagtctagggtacgtggggagagcttcatgaatccctgcattggccacccctgtaccacggccaatgattcaccctccctaaatcccagggccagatattagaacatctgtgatgaggactgattttctgttcgtggcctctggaagtccagtttttctgagctcaggggagccttggttgtatcttataggcaagagacgaatttacattttgccatggtgttaacaagcaaaagaagacaaaagagctcaaaatagacagtggcgtgctggggtcaggggtgctggtcaccagggcgagcagttatgggtgaagggctgaatttgcagggtcaaggagattgcctccaggccccttctggaaacacactccctgagccttgtagaattgagttgattctgtttaactgcccagtgaagaaatgacttccttgctttaaaacatttgacagctgtcttatataacttaattcttcattccagtggcttttggagcagcctcaaaagtcattttatcttcttggctctttgatattatttgtagtaatttatttaaagtaattagagacgggatcttgctgtgttgcccaggctggtctctaactcctggcctcaagtgatcctcccacctcagcctcccaaagtgctggaaataaggtatgagccaccaagcctagccttgatattattttttaatgggggtgtgtgggtgggtggtgatggggatattccagcagaatatcagaaacagagatgaggaaggcagagagagctcaaagacaaggctcaagttcatattccaacgccagtacctgccacctgtgtgaagctgggctaattatgtgtttaggtttcctccttcgttaaatagagttctacttatattacagggttgtcatgcaagttgatgaattaaatacgctaatatatataaattctgagtaagtattaaccaaagaaatggaacatcaatattggttcccagtctagttcacaggtgttatcaagatggttacctttctaagtgtctttttatttcactagttccaaaagagtatctctcaaaatattaggtagtatttagtcaacactttaacacataacttgtttttttttttggcataagaagcccatgtgaaaacacagttgaccctaagcctatgaaaaatgacttgtgtgtgggactggggtggctcataggagaaggaggatattcgtctggatttttactggtatgtatatatttttgggtactggagatggggacagtgagtatttgaagctcacagcaggcccattttgcaagttttcaggaaactgaaattcagagagattaagtattttgccatgaatcactttgtagtaagtgggagagctgttgcaaacccacgtctgtctacatccacagcctgtgctcttttcatatacaagggaatatggaggagaagggaagtgatggaaggctttaaaaaaaaaaaaaaaaaacttcagaagctgatttgagatttattcatctttggtgtactttctttactaaggcaggttgtagactcatgaaacctagaaggagttgaaaaataagggttaggattaaaaaaaaaaactagtgaaatcaagacaccattttgcttaattgaaggcttgcggaacattaaagcacaacaaaaacctaattctttgagtgtttctgaggccaagccttttcccacaaggcactgtgtacacggttctggaagctctcctctgtttgcacagtagtcactcatcctgctctcgggctctgcctgcagtctcttcctctgtctccgatgtcactcttctctgtcttcttcagaagctgtcatatgacctccagatttctctttgactccctgtattaccattagaagacatctacactgggaaattgctcagttcctgtttttgattaatattttatcagccgcaagaggaaatggtattctatagcaacactaataagtaattgagcagatgagatgctcttgctagctttggtaaaaagtcggggcaaggttacaacagaggagctctgatgagacttgggatgataaagtcaagtcgaatatctggtagggttaaaaatctaacagtgggccaggcgcagtggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtctgggtgacagagtgaaacccatcccccaaaaaaataaataaataaaaattaaaaaacctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatcccctgctgtacccagcaaatgctgagagccctgcttcccctcttgtattcaaatggctctataagagaggaagtagtacagctatcagtaacaatgccatccggtaattaccgaatcataaatgtttggggagctgaaggtcacgggcttagtagcaattctagtctgatgtttgattccttgtgaattttaaatgcttgtactctctatctgggtgatggtgttttagttgccagtggacagtctgatggaggtgggggaagagttattcttccatatttatttttctccaccttgggtgaaaaaacttcgcttttcgtaatgtggtacagtgtgtgcttctgtaaatggaaatggtttcagcacatcacagtcatgcttccctgttgaaagatgctccgttttcccgcatacatgatgtccagcacaacgtctgatttatgagagcatgaccctgggggcctctggaacagctgctcacacactccctttaggaggcccaggctctcaggggaggcccatagtgcagctaggagctagagttttaggatgaagaaattacaggtaagaacacagccccattttaagaaataccagtgatttctgtttttccttgttcttctttccctcagtattttattaacatgtgctactatacaaatacacaattcacttaggactctgtttcgtgtggatcacatgggagctttcattaaattgtggtgattccaatgtgagtggttatcaagtcaacatcaaataacatgaagtgtgttttagtcggcaaacatcactttgtaattctctgatgtgtttgggttgattcccttctttctgctctttttctctttataaagtaaacatttttattgcaaaggtactgctattgttagtttctaaaggcacttgtcatggtgtgactaatattagaagcagacacagccatgatgagcaatactctttttttgtttatttttgttgttactgctgtaagccactttcttctccctctccattaaaatgcaacttaattggtaaagtttagttgactagagatttcatttatttatttatttatttgtttatttatttatttatttatttgtttgtttgagatgagtcttgctcttttgcccaagctggagtgcagtggcatgatctcggctcactgcagcctctgcctcccgtgtccaagtgattcttctacctcagcctcccgagtagctgggattacagttgtgcaccaccaggctctgctaatttttatatttttagtaaagacggggtttcaccatgttggccaaactggtctcaaactcctgacctcgtgatccacccgcctcagcctcccaaagtacttggattaaaggtgtgagccaccgcgcccagcctgtatttatctttttaagtaacaaagtattagcattgtgataaataatatttaatatatagtaagggaggtcaaagtatgaactattttgattttttatgggttttttttttttttttaaagaatgcgttgattttgtttttctttcttttttttttttttttttgaggcaggccttaggtctggcacccaggctggagtgcagtgacgtgatcaaggctcactgcagcttccacctcctgggctcaagcaatcttcgtgtttcagcctcctgagtagctggaattacgggctcatgccaccacacttggctacttgtttaattttttgcagacatagggcctcactatgttgcccaaactggcctcaaattcctagcttcaagcggtcctcctgccttggtctctccaagtgctgggattataggcatgagccactatgcccagccaaattttgtttttcttttctttttttttttttttttttgaaatggagtcttgccctgtcccccaggctggtgtgcagtggcatgatctcggctcactgcaagctctgcctcctaggctcatgccattgtcctccctcagcctcctgagtagctgggactgcaggcgccagccaccacgcccggctaattttttatatttttagtagagacggggtttcaccatgctaaccaggatggtctcgatctcctgacctcgtgatccaccagccttggcctcccaaagtgctgggattacaggcattagccaccacacccggcccagattttcttataaagtcaaatgggagatacttgtttgcaggaaatagttcttttggttcttacttttccataaggattgagtctcaaaatgtctggtagcatccactgcattttgtaggggacaataacaaagaagatgccagcaatatcttctatcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttcagaaagatgcacactgctttaaaaaaaaaaaaaaaaagggcaaggggaggtgtgagaagaaagtataattctttttcttctaacgggagatataaaaatcatataagcatgatttatcatttgattggaacattgtattttatggttgcagagcacatgtatcatcctatctgcttctgacacccagtaagcagctctggcttttataattttgatgaaagaggtttcctaacagtatttcggtgtgcatgctcacacaccagccctggtcatcagtgaacagattcttccaggtcttcattgtagcggaagaaagtgagatcagagatcccgaggaagggcttcagtttcaccagtagtggagctagggagtagcggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacaggtgtcccccagattggatcctctgctctaggacacattcttgtcctagagcgggttgggcaagaggcttttctctcagtcaccagccccaaaccctgtggtcttgccagcccaggacgtgtcaagactgcagcctttgctgacctgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagcgagggcaggtgcaatggctcacgcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcgcttgaacccaggaggtgaggttgtggtgagccgagatcatgccattgcactccagcctgggcaaaaagagcggggtaaaaaaacaacaaaaaaatgatgtaggaatgaacagatgaacaaccccacacaacctaaggacgactttgaatcaattcttctaagctggtagcagaagccacctttccatttgacttgtatctcgctctttttttctttcttttttttttttttggagacagagtctcactctgttgcctagactagagtgcagtggtatgatctcagctcactgccacctctgcctcctgtaatcaagagattttcctgccttgggcccctgagtagctgggactataggcatccaccatcacacctggctaatttttgtattttttgtagaggtggagtttcgccatgttggccaggctggtcttgaattcctgacttcaagtgatgagactgcctcagccagccaaagtgctgggattacaggcatgagccatcgcgcccagccagacttgtatctcttaatgagtttaactacatttaaccatgtatgtgtcagtcctactatgcaccttacagctcactaaccctgtttaataatgtatgttgttacatttaatctttatggtagcctcatgaacaggttcttgatcaggagtgatattgcctgccagggaatgcatgtcaatatctggagacatctggggttgtcagttcaggagggtagaggataggggggaaaaggtgctactggcatctagtgggcaaaggccagggatagtgctaaggatcctgcagtgcaaaggaccatgcccaccacaaaatatcagcagtgcccaggttgggaagctctgtgccattgtgcaaagattcaaggtggctatgtcacaggactggtacatgtcctttttttttttttttttttttttttgagacggagtcttgctctgtcgcccaggctggagtgcagtggcgtaatctcggctcactgcaagttctgcctcctgggttcgtgccattctcctgcctcagcctcccgagtagctgggactacaggtgcccgccaccacacctggctaattttttttttttttttttttttgcatttttagtcgagacagggtttcaccgtgttagccaggatggtctcggtctgctgatctcgtaatccgcccacctcggcctcacaaagtgctgggattacagacatgagccaccacacccgccctacatgggtattctaacccagtctagtgatagtccaacctcctgtactatgagtaattagcaaagaattaacagcagaagatcgctctcaccaaagcccatccagaaagtggctcgtattcaaggtgctaattagggtgttttgttgccagtaaaaacatgagtcagatttcatgattgattcatgatgactttaaaattaatgctgctgttatcatacaaagtagtggtaagtggaggtaagagaatgtttttgctttggggtactaagtcatcgttataataaacacacagtaaacccatttatctcaggcttaatgctttcttgtttcttctaagcacttcttaggtgcctctgggctttttaacattctttggcagttgtaatttattaattgatttttaaatttggccggtgaaaatgaactttaggtaggggtttgaggaaaatgaaaaggcctatttgtttttcagtggctggttcttcgtgttcagcattaaggattggtagaaatcaggcaacctctatgtaacctcagccatcttggattcccagcttactcacatcatagatggagagtcagttgtttagaaaaaaactttcttttttttttctttcctttttcttttcttttctttctttctttcttttttttttttagggagggtctggctgtattgcccaggccggagtacagtggcacgatcttggcttactatagccttgacctctctggctccagtgatcctcccacctcagcctcctgagtcactgggactacaggtgcacactaccatgcccagctaagtttgttcattttttgtagatacagggtctgactgtattgcccaggctggtcttgaactcctggcctcaaaggatcctcccacctcagcctcccaaaatgccgagattatgggtatgagctactgtacccgaccaagaactttctattatatagattttaattaaaaacagtcctgttgagtggcctctttatcaaatgcattctcacataacctcatagaagtgagccctcttactgaattatgtggctggggttcttgggtatgttttgttctattttctggttggtggttttctttctgtcgggtcccgtgggctctttctggacctcttctcagaatgtttttcgttttttttattttttgagatggagtcttgcactgtgtcctgggctggaatgcaatggcaagatccctgctcactgcaacctccgcctctcgagttcaagcgattcttctgcctcagcctcctgagtagctgggattacaggtgcatgccatcacacctggcaattttttttttatttttagtagagatggggtttcaccgtgttaggcaggatggtctcgatctcctgacctcgtgatccacccacctcggcctcccaaagtgctgggattataggtgtgagccaccatgcccagccctcagagtgttttaaaatgcatactattaaatacctaggattataaagggagccagctatacttacatatagttctctctgtgaccctgtagaatgcactgaagcaaaaataacaggtaatgctaatcataaagttttacaaatctcctgaagagtcttgttggtttccgtgttgatgaagcaggaaatttccctgacccctttgcaggcaggaagtggagtgcggatgctggaactagctggctgctttggtgccagtagaggtgaactgcactcacttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttcagtggagggtcagcgtgacagccttttgcacccacatctgggttcttgtccagtgtccaggaggaacgaggtctcatgagcaaattttaaggatggcagatgtgggggattttattgctgatgaaagtggctttcactgggaagataagctaaaaagaagacaaagcaggaaggtaattttcccctggagctatgccatcaagctgttcttctgaagtccagccgcttctctccaactgtggtctctaatttccagctgcttctcctcttttcttcaatgtgccagcggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcataataatttttaacattgattgagtgtggataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcatgagtcttggcatctttttggtagagaaccttgctaggttctcacaatgtagaaattaagcagaaaacagaggtctcaatttgccttttcagcgtgaatgcagactcttacattcagtgctgggagtctttcttgagggacagtgagagcgaggaagggtttccattctccgagatggatggttgcattagtatttatttcctttttgtttttccttaggatgagaaagaaggcagtggagcccttttccttaggttagaatggttctgttggttgaattgtgcaccctgtttggttgaaacaattggacagtaaggatgtgactattattgttgctctctaatactttattatgtcataccaaaaattatcttttgtattttgctaccagttcttttagtttctcttacatgtatgaagttggatagttagaatgagatgaaaataaatgggctgggcgtggtggctcatgactgtaatcccagcactttgggagtctgaggcaggtgaatcacttgaggtcaggagttcgagactagcctggccaacatggtgaaaccctgtctctactaaaaatacaaaaatttttttgtattttgggattcggtttaggtgatgtgtgtctgtaatcccagctacttgggaggctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaataactttttcagtctctttctccctttcccaccttcccaaaagggtgggaaatttttaaagtaaagtaataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttctgttataaaatcatgtttttattgaattacattttaatattggtatcactttaaaatgaaaatgagtacttgcaaaatgtatttttgaaggagttgggtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactgtattagtctgttttcatgctactgataaaggcatacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattccttgagacttatttgctattgtgagaacaccttgggaaagacctgcctccatgattcagttacctcccacctggtccctcctgcaacatgtgggaattcaagaagagatttgggtgggtacacagccaaaccatatcaaaaaccatttataaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcacttttgggtcagttgagtctaacataggggtgtccaaacttttggcttccctgggccacattggaagaaaaagaattgtctttggctgcacataatatacaattgttgatgagctaaaaaaaaaaaaaatccccaaaaaatctcataatgttttaagaaagtttatgaatttgtgttgggccagattcaaagttgtcctgggccgcatgtggcccaccagctatggtttggacaagcttagtctacaggttcttcaagaggggcttgagcatttgaaagacttctagtgggagagatcacaaggtacaactagaaaatcctgggctggcctgagaggcagacctgtgattattttgctctttgaaagttgtccttctgcacccattttccccagacctaacctcgatttgtgctccaggtctgagcagaaatgttattccctccagaaagccttccctggatgttgagggatgaagttgtaggcccctcccgaatgcgtcctcagaactcgctggttctcgtcctcgccctcagcatacttgctcattgtttgtttccatctctatcatctctgtgagccctttgaggatggatgtgtgtccatcttgttaacagttggctccccagtaaccagtacagtgccagatacagagtagtaaccctacattctagcgtaggcaaatattctagtatttgccaaaactagaggatgaatgagtgatgggtaagagagttctcagaaaaatggatataaacaatattgtaaatcatatttggaaaataaatattagaatcattgaatccctgagttatagaaaaatttattaatagcgctatctggctactttttaaagtgtggacatcctcgatgtattagctatgcatctgtggataggaggcttacccactctgagtcttgtcaaataccaaacacaggaaaacaatatcttcctgagaatgttgtgaagaatatatcatccagtcagagtgaatcagcttgcccagtgcttggcatatagctgctcaagaaatattaggcattctttgttattataaatcccctttgtattttaaaatcctcatgtatcactgaaacaaccaactgaaaaccattgagaggctcatggtgaaagaagacagacagtgtaatttccctggaaactcaattttgattcagacgtccacagcatctcatttctgcctttaaaaaatttcaagagtgacattttggcatgactggactcacaggtggagaaggtatgacaaacattctggaaatcttggaaggtgaaatatagggaagatggcccctatggaggttcattgtcccccaccttattctaaataatgactttcttaaaactacatgttttgggggaatgtcctgcaatattgctttacatctttttatttttttatttcattttattttttttgagacagagtctctgtctccaggctggagtgcagtggcacaatctcagctcactgcaacctccacctcccgggttcaagcgattccactgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcacccaagttcctgtccgctggtagaattcacaaagctggttttatgtctccttctcttcctcttccagtgttgtcttttccctgcattgagatagcattgcatggagatccttgtactcttcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctcgtcttctttgttacaatgtatgttgtggtctttgttacaatgtatgttcacgaattcctagaacactgttcccgttggccatgggatcaggggaagagagaaggaagagagaaccagacacaagttggagggaatccatctccagtgctgctcagaggtatgacctagagcaaggggtttaggctttcttggactcattttcctcggtggtgaagtggggataatttattgacagtggaccgtgaggttctgcgcacaaaattcgttgcatagcacctgatacacacaaagctttcaggcaaggttagtttcgggtatttccagccttagtcttggctgtgggagccataatggagttgttcagaagtttacagctagtgtttataaattgcttgccatggggccttgtatacagtaagcattcattaagtgttccctcctattatatccttaggtttaagatacaggcaccacaacataaaccacccccagagtacacatgcatgggtgtaatttggtgccattctcctcccttttgcccccaccaaaatgaagtttttagtgtaaatgtcatgtagattttaaccaaaggttgattggagggtctgagtttctcagctaaatgaaggcatgaggactgtatccctcctgaagggtgtgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaagaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccatgtctgtgtagcttcatcatagatctcagcttaaggacaatgaaagtcgtttattgagtacttagtatgtgctggttgcagagccaagtcttttttttttttttttttttcctccttttttgagagagagagtctcactctgtcacccagactggattgcagtggcacaatctcaactgactgcaacgtgcacctctcaggttcaagcaattatcaggcctcaacgtcctgagaagctgggactacaggcatgtaccaccacactcagctaatatttgtatttttagtagaggcggggttttgccatgttgtccaggctggtcttgaacacctgacctcaggtgatctgcctgcctcagcctcccaaagtgctgggattacaggggtgacccaccacacccagccagagtcaagtatttcaagtattagagttgtctgcctgcctccctgtctccctgccttccttccatctgtttgttatctgacttaatctttgaaataacccaatgatacatgatatgcattttctaggtagatagatgaagggttaggaagatgtaacttgtcctaaatcacgtgtcttctaagcggtggaactgattttctcactgactatagatgttgagcccattaatgtgatacctactgccttttaattttaaaagttctcattgttttatcgttttcatcattatcatatgatttacctcttctcttgtgtcttataatccgattggtcatgctgacatactaaaccatattgtttgccactgggaaccaattcatctgtgaaaagtcatacagataggctcgaagaaagagcttggttgtgatgttgttgttgtgacaactgtctcgggggctggagttagagccagggtcccagctgccacagttcatgtaggggtagaccagtgcttccttttgggtgatgaggaagctggatttggcagctggttttgtctggatttgaaagggaggtaatcaggggtgtgctgggagggccagaacgatccacccacgtgttggtgccacccggcagtggaaaagcctctggcctcggccttctccggaaggttgtccgcggtgccagtgagagctgcttttcaccttacagcagccccggcctatctctcaggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccaaaaaaaaaaaaaaaaaaaaaaaaaaaagcggggcaaggggttggagaatgttcatatcacattattttggatgtctggggttgcacctggaagctcagatagcaatatctaggcacggctgccagcgctctatacattgacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgagcatgctctgaactcctgaactgctcattctgttctctgagagaattgctcaagctgcagtttatcattatatgcctccaaagactttgtgtttcctatgtttgacatcgagatagaatttttcataaccctttactagtaataaatttgattgttaagggaccaggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaatagctgctttggacggcaaaccaagcaatgccctttcacagctgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttcccctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacagcattattttagggggagaggttagagtagaattttaaagagtgcatttctcttccagtaagcaattctgcatcgataaaaagtggagaaagaataagtgaaaaaatatttagttaattcttgttgacagaagtaggacttcaggtccacatatatttcattgtagagtgcacacatgcatttttaagaatttcccgattctcttccacgtgtggacagattggcacatatgtgtgtgtgcaaattgtacttgcagtggctgcctgggaaatgaaatttctgcaccttgccagagcatgttttccctctaaagagaggcagctcataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatcagatccagtacatatttataaaaccacacttacatttaaatacaggcctttcccatttcacagtgtttctagctcccctttccaatacatctctctctctctttctctctctctctctctctctctcacacacacacacacacacacacacacagccaaatcagacaccaatataaactgtagagttaacattctttttccaccctcacactttttttagctccgatctgtgttcaatttctgcctgagagagtgatatattcatatatttaggtatagttagaaaaagcaaaatggtaacaatagaatcttgatgggattgatctcctgcagcaaggagcaacagaaaaaaaaaaaaatggaatcaagaacccaggtgctttttataggttaattgtgcagggttatcatgtatctctttaaaatcaccatcttgattctgagctttggttctacacattagaattgttgcctgggcctggatttttccccttgcatgttgcgtgtggtagtccagcacatttgctgattgcaaatatacttgtctcttctcatgggcattactagtactcaggaaatcattgatgtggggtaaaatgagaaaaggattagttttattttggacagataaacaacatgtcattttaccaattgctcattaatgctgatatttcccgtgggtctctgactctgaaatctgcatggagtggttacaccctgggcttgttagctcctacctgagctctgagtttctgtggatttctataggctcctgcaaattttatctagtggatattttgttaaaaaaaaaaaatggggtctcattctgttgccccggctgcagtgcagtgacatgatcataactcatggtgacctcaaattcatgagcccaagcgatcttcccacctcagcctgagtagatgggactacaggcatgtgtcaccatgccaggctaatgtttaaaaatttttcttagaggtagagcctcactttgctgcctaggctgatctagaactcctggcttcaagtgatcctcctgccttgagctcccgaagcgctgggaccaatagagatttctctgagaattaggtcccccactattaataaggtcattgtcagctgagttggggaggtggcgtgggtagatacaattaatttagattttttaaaaggcttttgagaatattcggagaacctaatatattttgagacctgacatttattttaaacgtgaaaagcaatttacaaaattgcacatactctataaatacacttctgttataaaaatagacacgtacggccgggcgcggtggctcacgcctgtaatcccagcactctgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagagcccgccactgcactccagcctgggcgacagagcgagactccgtctcaaaaaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaataatacccacctcccagggttatatgtcaatgggttaggcacagacctaggaactcagcaaatggactactatgaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtataccaaaaaaaaaaaaaaaaaaaaaaaaaaaagtaaattgcacagaccccagcttaggacctggacttaatcttcatgatgtttgtaaagtaatacttcttggagaaacctcccaaatttctatcgacactagacatctcaggatttgaaatgttaagctaacagaaattgttcatcaggtgtatctccagccctccgtaaacactgccggatggatgaacctacgtaatgatctcctggtgccattttcctgactgtagatacttgggtaaggaggagactttgactctagatgacatgatgtaccctgtgttctgcaagctggagaacatcatgtagaatctgaaaattaggagagagaggcaatcagaagaagacagagtggtgttgcagggacctgcagtcagcctagtcccccagtttgcgtttgaatttggtcccagattttttttgtttttgttttttagtagttaaagctgagagcaaaccacattgcttactattgtcagggaatgaaaactatgcaacagaagccgatgtgcagaggtgaccgtgttcgctggaattgaacttaagcaggttcctaccgcacagatccacacaggagggattgcgtaatgcacccagcagagttgtgctcaactgtgattttataaaagacacagaaacacatattaaatagacaattcttctatcagccctctaaactggcataaccttgaatcataattcaatgaatgcatttctgtgagaagtgaaggtaataagctccaagtgctttcgtttcctttctttctttcttaatgcagggaaaattgagatgggattctcagttaaaacccaaacgacgggcctgggggttgtcacaatgtgatccctgaggatgttagccccaatgtctttctgtagccagaaccaatagaaaaatgagaggaggagagtagaagcagaatagcaaacaatttttcctttcatggtctacctgtgtgactgtgtatatgtccagaaggggatgtggttggggaagggcatagtacacatatttgagcagagtacatgtgtttcatttcttgctcatacgacatgtccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttcacatacagcgagaaggattaagaggtactgtattgttggttgataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaaccctcagttgtaatggaggcatcaagactataagacccaagaccttaacttttgtgctccttgtcttgtggagggaacatccatcctcaaaacagaaacctgtgagatcccttgaatatactgacaatacactgatgagaattgaatgccccataaattgcatctcccgcagggcctgataggtgccctgtcttcctgcttatgactctgaaaccctgtttatttgtatcaaggacggttggtactttaatcatcaataaactaacatctcaacagcctgccataaatttcttgtcaaaaaaagaggttatgattagaatactgtgattaaagagaatttgtagatagacttacatccctcagtttcaaagcttctagtagtagggcttagaggttcctagagtaggaaaagcctagccaagcagaaacccatgtttttgactttcaggatatttgtgaattaatttacttgcatatattggccaagatctagcataatctcttaatattcaatgaataaaaaattgagttttgagagcaaatattttggtaggaaatagagaactgacactaatattctctctgactataattgtaaaacagtagatgtctttcaccaagcgctaacattatattaattattaataaaatccaactccttaataatacaatcatagttaccatttattgagagcactcttctgaacattttgcattctttatttaatcttccctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccattttttaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatccatctctacaaaaaatttaaaaattagctgggtatggttgtgcactcctgtggttccagctactcaggagactgcggtagggggatcacttcagcccagaagttcaaggctgcagtgagctgtgatcgctccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacaccagctttacaaaagagagagagagaaagaaagagagagagattatttctagaataagcaaaccaaacgtgaattaagttttcattctcattttagtgattctctaagtacatacccacattctgattccctcagcactttaggactgactgattagcagtaactgccctcccactggtaccactgtggccagggagtgactgcaagggtcaaaacttttgttggggagctgtttggactaagtgaatgtccagccccaactcagggatgttgtattggttctaatctctgcttctgaggaaatggttacctgcagggcgattgtggcctgctcctcgtgggatatattgagatggttccttttaatccatttcttttaaaaaaaaaattctttttaaagagatgggatttcattatgttgcccaggttggcctcaaagtcctgggatgaagagcttctcctgtcttagtctcctgagtagctgggacgacaggtgcctgcaaccatgtctggcttaaatccatccttaaacaagttcaatgttttatttccttcagataaaatgagagtggagagaccacagtgatgcccaggaatagtcatggttggcgattaaatagccattgagtctctattctgaaacaggcaccgtgttcatttgctatggctaacatgacaaaataccacccactggggatattaaacattagaaacttactgtctcacagttctggaggctggaaattcaagacaaagttgctggcagggtctctctgaggcctctctccttggcttgcagacggccgccttcttgctctgtcctcacgtggccttccgtctgtttcttggtgcacatccctggtgtctcttcctcctcttataaggacaccagtcctcttggattagggcaccacgcttatgacatcatttaacttagttaccctttcaaaggctttgtcttgaaatacagtcacatggagggttagaacttcaggatataaatttgagggggacgcagtttagtctgtaacatgctctatgctgggcacaaggaatgttatggtggataaggggaaaatggtccctaccctctgtcagttttttatggaagaagaaagacggtctttaaagaaatttacataattaatcacaaaaagctaatactatgacaaagaatgtaagttactaatacagcttagaacagatgactctaaccttgtgtaggagctagagaaggcttctctgaggaggtgaggttggaactgaagcatgaaagggaacagaagggggtcaggcaggagaaggcttgggaccaggaggtagagaaaacagtagtgtgatcagaactttaaggcccggttctgtatacaacaggtttcgggacttgaaaggcagcccacattgagtgtaactagaaagtgagggcaagagattgttcaaaagaatactggacccagagtttcatcactttgttaattacatctcatattgtgggattgcaattaccttgcccaagaaaagattatttacgattccattgtttatattgtttgttgaaataattaattctcaaaacttctggatacctgagactcagctaggaacttatttttaaaatataaattcctagtcccactccctaaagattctgagttagtacattcaggatggggtctaggaatcagtgtgtttaagaagtgcatcaggttcttctggtactgattgtccatgaaccacactttgagaaagctccatctaaagagataagttactgacgtgtgttaccagagagagcctagaaaacctgggcacaacagtagttgttaagaactaccagacctgggccaggcccggtggctcatgcccgtaatcttagcactttgggaggctgaggcgggtggatcacttgagcccaggggtttcagatcagtctgggcaacatggtgaaaccctacctctacaaaaaatagaaaaaattagctgggcatggtagtgcatgcctgtggtcccagctacttgggaggctgaggttcgagggttgcttgagcctgggaggtcaaagctgcagtgagccaagatcatgccactgcactccagcctgggagagtgtgagaccttgtctcagaaaaaaaaaaaaaaaaaaaaaaaaaaaaaaaacaactaccaggcctgttggaatgtctgccagtttcaacccacggggatagggtgagatgaacattgattgagcctttacattggagacactataacaaatgctttgcgtacatcagctctttcaaattaatacaattctactagagggggcactattagtatccccaatttacagatgaaaaaaatgagggacagagaggttagatgtgtatctaaggtcacatagctcacaaacgacacagcatgcacccaaatgccaggtttcaatgaccctgtggtgaagtgtgattgctggcatttgcctagtgttgactgtgctctagacactgtattagttacaagtgattctacttctcattcattaggccatccagaaagccttgtgctttagtctgtcctggctactataacaaaatatcataaactaggtggcttataaacacctgaaatctatttctcatagttcttgaggctgggaagtccaagatcaagctgctggcagattgagtgtttggcaacggcccactttctggttcctagatgttcacctccttgctatgtcctcatatcgtgggaggggcaaagggtctctctatctggcctcttttaagcccttaacccattcatgaaggctttgcctcaatgacctaatcacctcccaaaggccctacctcctaatatattatattggtgattaaatttcaacatatggctgggcgtggtggctcacacctgtaatcccagcactttgggaggctgagatgggcagatcacttgaggtcaggagttcgagaccagcctggccaatgtggtgaaaccccgtcttttctaaaaacattttaaaaattagccgggtgtggtggtgaatgcctgtaatctcaggtactccagaggctgaggcaggagaatcacttgaacccaggaggtggaggttgcagtgagctgagatcacaccactgcactccagcctgggtgacagagcaagactgtctcaaaaaaaaaaaaaaaaaaaaaaaaaattacgaattttgcgaggacgcaaacatttaatccgtagtactgatgtggatatgatttgagctaagactctgctgttgattctcttcaaaaacttggcagtagcccttggatcccattaattgcattcaacagtcatgtattttattaatttttgttcctaaagaaaaaaaaaatccagattgcttagaaaataaatgtgactcacgcagagcagaatccgaattttctaagtgatgaacatgttaacatattattttaatctaaagacatcctatccctgaatttagggggagacatttttttaagtaaggtttatttttaaaattgttttgcaaacattttaacagtacatcactgcctcattggatgaatcatatttttaactttcacttcccatcaatttaaacatcatctctcaaggaactgatgggccggttgactctaaatgattttgcctttcatgcagtattgttccatccgcctgccacagaagtgattccaggtcattccaatttatttaattaattttggagatgaaattattttgcccaataactagaatgctaatgggacttagtgtaatggtttagttcaggtttgttggtttgaaaataaacgccttcatttcaatatttgccttttggctgcagcccgttaactggtcacatgctgtaacctcattaacatcaaggcttaattgtaagttaatgtgcacctagtttttgtaaagaaggtttctatcttaactgccaagttttgccccccaaatatagccccaaactggcatttccaacagatggatgggttggtgtaatataattcatgcttttaaacatcatacttttatcggtgccttgataataaatatttgaacttatttttagaagttagaataaagtgaggaaaataaatctcagctctctagagtgtcactgtggtattgagatttgtggaggtgtactacatccgtaattgggagagattgccggtcgtaaaggagggacaatagaacctctgtagaatcaaaggcagaattaaaatctgcatgttaatagctttcctgccagccacgaatagattcattcttcacgtctcagatatataaagcttatttcaaaataaattctggggagcgttcaacctgattgaatctgctgtaagctctgttaatatatttgttcgagtcacttgcactcaaaaggtttttagacagaatatcacttttttatattattcatggtaatgtaattcccccctttaatctcttcagggtttcccattcagtcatgatatgcggttcagagaaagttggatcgaccattaatcatgctatctcgacttctgtgtgtctcctttttgtccatctcttaaatcagtcacttggcagcagcaagacatgtggccactccagaccatttgatcgaagagctcttgttaggagattaggctgctaatctgcaagcgagctaatggaaatcattctgggcaaggaaacaaaactgaacaacattagcaaaatcactacatattataggaatcaagtacattctgaacggcttaatcctacagtttagatatgaagcctaagggtaagatgaacgtcttagatgatctgagatatccaaatacctgtaacaaacatttgtatggtgtatgtagggcaggaaccccatcagaattggggaatctttaaaggattttttatttagccagataaaataaacaaggacagagttgactgagaaaaaagaaagaaaaaaaagaaaagtcaggagaggaggactgaaaattcccatcccacccccgcaacaatgaagggaaatgcctaggttgaaaacacgcaatacacattcaataaatgttcatggttgaatgaagttacctggtagggatttaatctttatttcaaaaagagtggctgtgaatctttaaaaatttctttggttctttaacattctcttcttcactaaacccaaattaataattccttactattgtcattaaaagttctcactggatcattccatttatactcagagtaacaaagcaaacccaattatttgagagacactgaaatgaattttgagtctagaacagcatctgcaaactttgcaaaggttcacatgataaatattttctgctttgtggcctacaaggtacctatcacaactactaagctatcatgcattagtgaaagcacatagataatctataagccaatgggcatggttgtgtgacaataaaactttatttagaaaaacaggtggtagactggatttagcttgtgggttgtagtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaattcttgtcaaatatcttactcctgggctgtgctggggatggcagcagagtggggtggttggatgggaaggcgggaaagagctagcttggagatgatacgcttttccatccttgaataacttgggaaaaagtcaggagtgtggaatgaagaattggaatataaaggctgagggcggacctaattttttttttaaggattaagaaaaaaggagtaagagagatggtatgacttatcacttggctggggactcagcattaattgataaatccactgtaaggaatgcatgacactgtcttttgaagaaagacattgcatgttaggattctgagtaacagtcaatatattcagtgaaacaaatacctaatatattccatgaaacaagtatcgtgaatatattccatgaaacaaatatcatgaatatattgtgtgaaacaaatatcgtgaatatattccatgaaacagatatccagtatattccatgaaacaaatatcatgaatttattccatgaaacaaatatcgtgaatatattccatgaaacaaaatactgtgaaatcataccactgatttttgaagaaacctaatgaaaacagcatgctcctatatcttttttctgggtgatctttagatatctcgtcttccaaacttttgtgtagcattgtctgaattttcccaagaaaggaggatgttgatctcctatttatttatatttatttaaatttttaacctttacattgacccagtgttgtaaggaaatgggagaatattgccctgatgtctgggaaattgggactcccatcctacaattcaagtgttggaatgttgcagggaggctgggctaaggtgttctgttcctgtctctggttcaaaggaaaggaatagcctagacctaaaggattctgtctggtagctgtttgctcttcgcgcctgtgctttgaatggtgaataccctcggcgggaggcaggcacctgatgccactgcccccgccccacctgcccccgccccgtttctcagatcacacaggcaggctgaggagcgcttaacaccccagcctcccatgaagcatcctgaaaaagcagactttgtcttcctccatcagctttgtttgtcctctgccgagactccagggacatgattgctcttcattttacgctcgagatcaaaataaacagaaaccactttcagctttcccgttccagggttaagtgcccaagcaggtgttgtttctgttatgtggtttgcagtgagcaaaaccaccccctcttacctgtggcagcaaaggcagggagactttgagacctggggagggctctctgctgtgttaacagaactggctcttggttggggggtggggggcacccattcttggcttcttataacacttcctttctcatgcattacctggggctccctctggaaagaaaatggtggagaggttactggcctgatgacccagggacccaggcagtccttacagggacccagaatttcacatgcaaatgtgacctccaattaaagctggacttgattaaccccatttcccctcaaaagatgatacttgtaatgccgttccgatgaggccgtctcactccgtaaactgtcatctgatttacacaaagccatctgcttccatacggggtgttttatttgggatccaggaggggagaaggcgcatctgccccctccatagcatctgaatcttaatgaataaaagcactgacacttctttaaaagggaatagcgtgatgctatttacagtttatacagttttgtaatccagctccatgctggatatttaccgtcagtcatttgaggaagttcacttctctgctggttttctgagtgagggagcgatgagtagaggagcagctggagggtccaggagccccctgaactgagtatccggtgggaggtcagatttccgcattcagaacgagagctcatacggcatccacgcgtgtctttctcatgcatatccccagcccgagtagaagaggacttctgcatctctgttagttctttctcctcctaagaaaaagcagattttaagtaacttatcatttgttcatttaattactcattctttattccttcttcattcattttccttttctccttcctttctccctctgttctctctgttttaacaggttttattcttattgtggtatggtaaggccaagatgaggaaatgactgctattgcaaagatggtttgttactcacagatccatggggactccacatgccacagggagttacctgggaaagccccagggttgggcaggaggcagagggagagggggagaactgtcaagagttttgagctggaagctattatcctcagcaaactaacacaggaacagaaaaccaaataccgcatggtgtcacttgtaagtgggagctgaacaatgagaacacatggacacagggagggaaacaacacacactggggcttgtgaggagtggggttgggggagggagagcatcaggaagaatagctaatggatgttgggcttaatacctaggcgatgggttgataggtgcagcaaaccaccatggcacaggtttacctatgtaacaaacctgcacatcctgcacatgtaccctggaacttaaatttttttaaaaaatgtttttattgtgattttcacaggaaagaaggggccaggcagggtaagcaggcttaggattggctggcttgggtcatttccatgggctctgggacacaggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaacctttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactcccacagcttggtgcagagagaaaagtgtagaaaggtcgggtgtcatacagcagagggctgtgatgctctactgaggagtggaagtgtttttctgagggcatcaaacacgccgtcaagcagggaggcaacaaatctgagttgttccacagatactttgagtgcagtacaagttggtaatgggtaacaggctaaaccatgtggcaccccttccctcttatcagcttcttgctaccatgcagaaaagtgctgaaggtggcctgccctaaggcagtagcactagagcagggatggggaggacttggtggccagatgcatgtggacatgatggaaagggaagagaagaactgtcaagattttcactatcagtggtataagccccgtagtaatatgcctagtgttccattattggaacactaagtatgtgggaattatttatatcctaccgctcaaagccatcaccaaggtctgatcgtgaaaattcaaaaaattgcaacctgaggcataaatgggttttaagctccatacagtaaaacctagcatatgaaaacagttctggctgatgggttggtagaagtgatagatatagatacatacatacacatatatgcacagtaatagatataggtaaagaccttgatatatgtacatatattgtatgatacatatccatgcatatacgtgggtgtacacacacaggtacacacaaatatatatgtgcctttggacaagaaaaaatccccaggacagtctcatttggcttttaaaatgctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgcataggcggcctgttctcccacaaagcactgagtaagaagaaaaggggcccggataaaccagcagggcctggcagacaacttctggctcccttgccatttaaggtcccgaggaatgtggagacattggtgggggccagggtgggtttggaaggacggattttttcctctttgtctctatctctctttctctctgtctttttctctttctctcatagttaatgctatgattttgtaaaaaaaaaaaaaaaaaaaaaattctagtttctcagaatcctcattggaggcatgtgtatatttctaaatttaaatgtattctcctatactgtccggggaaaggaagcatttttcaaccaaactgaaagggaaaggtactcttttttattctaatactcacatttcccaaaacatatccttaatattgtacatttggcacagttattgttgaatacttggaaggcgatgtgtatagcatacagagctgcagctttggactttgtggctttaggtaaattacttattctctttgcacctcagtgtattcttctgactaatggggacagtagcaacatcgatgtctcggggcttctgtgagtattcatcaaggtaatatatgcaggccagtaccacattccccactaaaggagtgccacttttttttttttttttactacttgcattattgttgttgttgttgctgtacgtctgaagggctttagtcctcttatgagcaaggcaaaagggacaatgttcaccctttggactggaagtaagaagcccctgcagttccaaatgactccacatttggaatgatttcacaaggagtgcaaaagaagcctcttgtttgactttgcccacaaatgccagaggaggactcttctgagccatgccaataagaaaaatgagaatgccagcttaaataaatgttatcacaatctctgcagaatcgtgatgtctccgattcttaaaagtgtctactgcagggtatttattattctgtgataataataaatcgctgcttatgaaatgcaaggaatcgagtgtcatggaggggaggaagggaagtaacagggagaagaactgtgagagatggaggtccagccaggcccgggctattaatcatcgccctccattatttcctgaagattcattcattgttccataggtacctagagggtcaattagagaccacagacaggctttttcaaagacgcaagagggtcaattaggccctccttataattttctgctttaacagcaaatgccagcctatcgtgcatcagatgcaagggagtttggaaataaacagggtactttccctcctcctctaaaaaaaaaaaaaaagaaaaaatccaacacagagacatggagacagtcggcgattgggaacgcttggcttgctggctgtcaggatctggttcaaggaaggcaaagggaattttatcaccaactgggacttgagaggagcagagttcttctggtctcagagcacggggaacggtcagggaatttgtatgatggagcaccctgttcccatatctgagatgattcatttatcttgagtgccatcttaactacaattagagtacaattataaagtatctacaatggaaatgggtcttgaaatcaatcgcagctggaccggcgtgcggtgagttgccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattctcgcacctcagcctcccaagtaactgggattacaggtgcccaccaccaagcccggctaagttttctattttcaatagagatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtgagaagcagagatgaaaatgtggaaggatgattgtgagaagtccacattgctccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaacttcagtgatattatttctccgccccccgcaccgggctcttgggaatatctcttagccctcaattgtcacattcattcagcagatgttagcacgtgcaggcaccattctaggtgttggggatacatccaaaaacaagcaggaaaaccccattctcttcatttctggaatgccggagcactgggcccatggagcccgtttcacttacacgtttttgtcgtctttgagtttccaagaagggagtggcactatagctgaagaggatgaccctctatcacagcctttgctaaaaccactgaaaactgtcttatttttcattttgcccggaaatgcgacacataagtgcattcctctagggaaggatttttttttttttttttttttttgagacaggagtctcactctgttgtccaagctggagtgcagtggcgcgatgtcagctcactgcaacctccgcctcctgggttcaaacaattctcctacgtcagcctcctgagtagctgggattatagtcacctaccaccatacccagctaatttttgtattttttagtagaaacagtgtttcaccaggttggccaggctgctctcgaactcctgacctcaggtgatctgcccaccttggcctcccaaagtgcagagcaggaatttcattggatttctacactgctgctttttcagagcctggaacagtgccaagcacatagtcggccctcagtgagcatttgttgactaacttaggtcacagatgtggggctgtgattctgaaggccccggctcattcttggctttcagagaggtttgctttcactcctgggcagcagctgccctggctgctgccaccaccgccttcccggaggtcagctttattttcagtgtttttgcccttccgatccctgggtaagaagtaagaaaatttctagtgcctggagtctccatcctcgtttcccagtcatatcctagaagctgcaaattgctggcttgtggatgtctttggtttggcctgctgaagtttgttttggattttttaatgaaataaattagctgtgaacatttaaaacttgggagacatcccatcaaaattgggatttcctgcttatctcgacaaagcagatctggcatcctttgcctgcattttacatttggctacagttggctggacttgagcagcggctgcccctctttagctggggcatgtgccctgtggtttgccatagtacccatcaggcctgcttcactcattgtagaaatggcctggcctcctaggcattggagatttctgttatgctcattcatgagcttgcctgcttacacctagctgttgtgttggttctcataggtctccctgattccagcctccaattcactgagctggcctctgccagtgtcacttctccccagtcttggctttgatcaagcttggaaaggcctggcctttgtgttgtcacattcttctgcctagagtatgccttttccttcaccaaaccaagtggctctttcggaagacttgcctgaatcctagaccccttctctctacaaccttcagtctgagttgggtaccttgcatcctcctttgttcccatactaacccctacaaccatggtcattttgtggttatctgtttaattctctgctggctattccaggctgtcagctccctgactacaaggactttgttgctcacaatcatatccacggcatccacacaagatctggccgctacgtggaaggacacatagttccgtctggcttggagcctagcttgggagagggacagtagtggggaagggtgagcttggagatagagctgaccttcccaggtgcttcagcagttacagcaagattctagatcttaccctgacagtcacagaaagcactgggagcgtttatgaatgttgtggtatctcacataataaggggaccatgcatgtattttagaaagagccctctggcttcagggaagaacgatggatttgtgagggtcaggactggtagcaggtgggctcctagaatagtcccggcaagagatcatggaggccagagccagggatggatatagactaagacatgcctgtagactgagtgtcgaggagcaagtagatcaaattctagcatgagactgggagaaagagatgttctccagccaatggatttatgaaatgaatgaactttttccctttcctcccaagcattgcctggatcaccttgttaatatggtttcttattaaacgtgctggaaaaaagaggctctaagtgcgtatgcttttaaagcaacactattagcaaatggccactggcttcatttttcctgtgcatatatttttgtgtattccgggaggattttcttttctttttctttttaatcctcctcctcaagggaaacattcttctcacaatagcttcctggtagaaagttctaactaatgactttaatcgtgtgaatgtattgcagaaatggacaggacaattctcagcccattcatcttacagacctcaagtgaacaggcacaaaacaacaggctccaccctccttcccccctctatctcatactttacctcaatttatgacttggcttacaatccgttgcagaaagcctagctccccagcttctcctgaatctacgtttttctattttgtctgaactagccaaggtctctggagtttgctgttatattgcttcagagaaattagtgacattgaaaggctgttgtcttttttagtgtacttttggttgttaggagaaatttacaaggccatttttttctcccgtctctgcagttcaggagattatattagaaaatattctatacaaaaaatatgcatagtagggcttttctccagctagtagctcagaataagtcagtactactgaaacaggtaccttttgtggaattgattctgaaatctgtttggatctgaaatctttctttcttgcctttgagtaagatacggcagagaaaaacaattacactagctgctggtctgtatttactggttagaatagaatattattaccatcaagaataacattagtggccaggtgcggtggctcacgcctgtaatcccagcactttgggaggccgaggtgggtggatcacctgaggtcaggagttcaaaaccagcctggccaacatggtgaaacccccgtctctactaaaaatacaaaaattagccgggtgtggcggtgcatgcctgtaatcccagctacttgggaggctgaggcaggagaatcccttgaacctgggaggtggaggttgcagtgagctgagatcacgccattatactccagtctaggcaacaagagtgaaactctgtctcaaaaaaattaatgataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagcctagacacaatgtgactggcttctctgctcagggtctcttggggacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagctcccagaggcaacccacattccttgacttttggccccctgcatctcaaagccagcaacagaaactctcttgtgcatggagtcccctcctgctttgaatctctctgactttccttgactttgatgtctaggtctggatttcaagggctcagaaactctctcatgcatgtagttccctcctgctttgaatctctctgactttccttgattttgatgtctaggtctggatttcaagggctcacgtgatgaggatagtttctttatcttaagggcaactgatgtggagtcttaattaacactggcaaaatcccttcatgacagtacctagagtatgaattgactcagtaactggaagaatgcatgcgtacaccatggaccgggaatccgggaggccaatttagaattttatgtatcaaagccccatttttttttgaataacagaaaaaaaaaagagacctgatatttggagagactttttcaaaagcagaaagtttaatataaaagaaagggggtaattgaagaagatataaactgcaaagaaaggatgttaggtagagcgccttatagggaatcagaggttttattacaggcagacacggcttcacctgtgagccgagcaagtgattttgcctgcagagaagaacgcagggttccttctatggctcaggatcttcagttaccagcagtggaagtgaattgaaaatagttggtctcttgagtgacctgatgcaactcattatcttctctgtgccttaacgtctctatctaatttcccattaaaagtaacaggaaaaagcgcaatgacttttgcaccaacctaacaatgggttgacattcaggattgctataatgatgaagcaatggcaaatggagtctttgtttttagccccgtggaggcatatgctgggcactcaacaaacatcacttcccctgcccttttctcagatagagttatccaaacaaattggatgctcaactctggatttgatccaagctctctggaaatctctagcttctcaaactgtttcgtggtggagtgccttttgggcacaggagaaggaaataagagcctcgcgaggtttgggaatgctgcctctagctctcacactgcatgcagaattcctactctgagagctcactttatctcaaaaacccatgcatattctgcatctactctgaattccgcagtgttgtgtgttactatacgatctagtgttttcgttgcttacaagttagattcacactccaggaatgtatctgttcccacatcccctgatgctgagcataccagagttaagggaggcaagcaaggcccctaacctcccaggttcatggaggtacccattctgcacttgttgaccttgagcttgaggactccataaatgtctgcccttggcattgcacgtgcctccctctgggctgaccctgctgggcctgtcacttactcccattggagaggcctgtttccatacatagctctttgtcagttgctcacactcggtcaatacttgccttcctttgaggccatctgcactcactgacaatctgatcgctcccctgaatggaggtgaaagcatgcaagctaggagttaagatctttaactcagggaagaccctgtctatggaagtgctgagctcttcagtgtcatcacagaaaagcatgagcccctccctggtacggagtcatcacatcccatagctgagcgacgtcggagctccacgatggggaggtgacacatagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttccttttattttatttatttatttcttttcaatactctgaatatcactggagcagctgcagattcagggcagtatggggtggttcaggaacagaactgacaggtattgaagccaaaaattgaacaataacaacgtaggagggagaatccaaagatagtatgtgttcaggatacgggcactcgtgtgggtgaacacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgtgtcctggttggcagatattaagtccacagataccaataattaatatctatggttgattgtaaaaatggccaccaattcttccctgtcccctgcatatgtacatccttgcactgtgaaattgtagatctcgccctccaaaggtgaagttcgtttgtccactccttgaaccaggatggcatgaaacttgatttgaccaatgaggcatttggaaacacggcacaagcaaaggcttgaaacgtgcttttatgttggtgcttgcccacttgctgtgctacgaacccttttacttctgggtgcgaacaagcccaggctagccttctgggcgatgagagacacaagaccatgtttccatattgccccagccaagagccaacctacagacgcaactgccttgctgacagcagacacctgcccagctgagcccagcccaaattgctgactcatgcaatcttgagctaaaaataagtagctgttgtttatagccactaatatttgtgatggttcattgcacagcaaaattgaatggagacaatacttttgaaattgactcttcgggagctgttgtaaagaagtaaaatgtgtagtgtttgcccttttcctcagctgtaggcctggtatgcagaagtattcagttatttggtgagtgaaccctcgctgatgccctggctagtgttttctgtctcaggaagcatgaacatttcatccagggttatatgctacagggatattcaagaaattgaagatccttgaaaatctagtctccctcacaaggatcaggtggcaggatctaatgggaggggtagagagtgagtgttaacacacagagaacccaggagacctttctcagaggtctcatatcaagaaaagatcatttctcctaagcaatcaatttctttttaaatctgaacctcatatctgagaatattcccttcttttatctggccactcgggagctcaaaaataaatttctggcacccttcttcctggctccagtaaagtcatacaaccatatggtacctctctggcaactaatttcacctatttccttatttgtttaaaaattttaacttaaattttttcccctcaagatctatttacggatcatcagttttattttttcttttctttcctctttttcttttgctcccttttctccccactcttgactcttctctagtttttatatgcagtttgtatttatccatgccatctgaaatcctccttcctttttaacaagacaagtagaaaacgaaaacaacatcaaaggatacactacacaattgttggagccctaggaaccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaacaacacatgcttatcatgttgcagttctggggagtcacaagttcaaaatcagtctcacctggtcaagatgtcagtagggcttgttccttctggaggctctaggggagaatctgtttccttgcgtttttcatcttctagaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgggaatacccagataatcttggataatcactccatctcagggtccttaatcacatcttcagagtcccctttgccatggctgatgacagagtcacaaatttggggaattagtgtgtagacttctcttgtagggagtcattattactctaccacaaccactaattctggacttcacgttccctcatccatagagcagggataacaatatcctccaggctatccgcggaagtagagaatataagctttatccagggggccactcagtgatgggagtcttccttatgaagctgtcccagctccatctctcaggactgaaatgtgggtaagaccatcacatttttcatcccccgccccccgcccccaacattgactgggcagatattcatacaatggcgattgttttgtctgcctggatggctttaacataataccatagactgggcaggttaaacagcagacctctattcctcacagtctagaggctgggaagtccaaggtgaagccatgggcacattctgtgcctgcctgaggctctctttctggttcccagatggatgcctttgtgtgtcctctcatggcagagagaggaaggggtctggaacctttctcttataaggatactaatcccatcgtaccccgtcccccatgatctcatttgaaattagtcacctcccaaagccccacctccaagtactgtcacactggggcatagggcttcagcatatgaatttgggggagctggggagaggaacacatacatttagtccataacaactatctcacttacctctctactaagtgattcagaaaatagcaagtatagtagtgggagaacatggtatcagaaccaggagagggtcctctggctttctgagttctgccaaaaaccaagttttgctgccttgggcctgtggcttctcctccctgattgtcgctggccttgctgtaaattgtgaggcatccatgtgaggcacaggatggttccaaggaccaactgaggctgtctgtgctgaggctgggagggtgtaagtgctcagaggcagccggaagctgtggtttttacctcccaagactgtgcagagcttccttcttctgtagggagaagtctctcaggacagggctcacaacagtgcagtcaggagattggaaattttagtgacaccaaagtgggctttacttcctcctcctagaattcctgccagaaaggtggagatgtgcaataaactgagcaccgatagagtaccaagaacatgctttttgcacattgtttgattcatcaatcagagtggggcatggctgtcatcagttcagagttgaaagaattgaagatcaaaggggtcacgtctctgtgaatagtattagtaatagcagcagtatcgatagcaatcatagtaattaaaatggaagcaaccaccagtgtaatcatagcagaaactcacatgtgtgtgctttctatgtgccaggcatgaggctgaagtcatacattcattatttgttaatcccaccctaagtgataggtgtattcatcattctcagtatcagaagaagaaactgaggttcagaatgacccagtaaagatcacaagcccaaccctggtgaagggcgtgattggcagaagcccaatttaagcccccatcatgtcctgacgctttcccaaagctgagctgcctgccagggtctttgctcttccactgccaagaagtaaggttttggttgggcgcggtggctcacgcctgtaatcccagcactttgggaggccgaggtgggtggatcacgaggtcaggagatcgagaccatcctggttaacaccgtaaaaccccgtctctactaaaaatacaaaaaaaaaaaaaattagcccggcgtggtggcgggtgcctgtagtcccagctactccggaggctgagacaggagaatgtcatgaacccgggaggcggagcttgcagtgagcagagattgcagcactgcactccagcctgggcgacagaaggagactccgtctcaaaaaaaaaaaaaaaaaaaaaaagaagtgagttttttttgtgtattctgaaaggttcccaagctcgccgcagcctgctattgtatttaaagggtgccctttgctgcgtaactagggcaaagaagaaccaactggctgttccccactggctgtggagagttccagctcatccaccctgcctctgtggctgagtcggggagaaaaggacaaagtttttctcccgcaactgggccaccaaaccagcagagcctccagccggggtggtctcgaggaggcccattaccggctggagtgacagagtgtgtcaagcctgcagctcgtcccgtgtctaatggaacagaaacaagcaccctgctgcccttgttttccagtggctcaccggggctctgcgaggtttattaatcttagcgtataatggaaaatgtgttgccatgtgaaatctagagcctctgttcactactccgcgaattgaaggcggcaggagtctttgtctcatttacacacagtgcctgcgagagactcttagggcagaagaacgccgtcgtaaaaatccgtgcggaatttgaaagtgtgcattaatgcatgtgaccagatggttctaaaatatgccactttcaccaaaaatcatcctctgaaaaactcttctgaacaacatcggctgtgcatagtaactgccttgagtggggccattttagaaaatatatgaggtacgggatgaagatgagggaggaaaatggttcctacttatcattactttgtccctccaaaagcctgcatgcgggaagaaaaatccacccagtgcaagaaccgtggcagtactcagaccatttagaatcactttgagttattaccaagaaattgctaaccactgctttccaagttatatattaaatttttcttttttttaaaaaaaagcttccaactttttttttttttttttttgagttggagtcgcactctttcacccaggctggagtgcagtggcccgatcctgggtcactgcaacctctgcctcctggattcaagcgagtttcctgccttagcctcccgagtagctgggattacaggcacccgccgccacacccagctgatttttgtattttagtagaggtggggtttcgccatgttggccaggctggtgtcgatttcctgaccttgagtgatctacctgcctcggcctcccaaagtgctgggattgcaggcatgagccacagcgtccagccccaacttcttaaaagccagaaacaactggctgttagctgtcacaatattaatactagtgtgtgcaagtaagtttgttttctgcttctgtcttacacgttttacgggctatcagtagatgcatctaataatcctaacactgtcatccttatacttgaggtcttattgtccacttctaccttagctatgtaaacagatgagtaacctactctggatttacccagatagtgctgttaggcaccacacacgatgagattggaggcacctgggtgtcagcctcttgggctggctcattacaggccactctgtctgaggaacactcaggtttgcaaaccgtttcttaaaattacaggatacctagggacctgttggggtgggagggaagaaccctatgggcagaaatgtgactttctgtagcaaagatgtactgtttcccactgagaagaatcaaaaatagaaaagtgcttccttgtctctctatattgttattaaaacaagtagatgcattttcattgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgcatgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattagtgaacgttttcatttataaagtgcttcttccttatcttgaaccttttatcctcttcttattgaccaaagagagggcatatctttgggagctgctaataaaccatattcgtaatatgatgtgacctcatcgacaggctgctgcttctagctcatcatcttccttgatcataaatacccatcggtacctcttgtcacatggtgctcttagagcttcctctttgaatttcacatgtgataagagatggtttccatcctgaagagcttgcagtgggatggttatcggaaagattaaaactctaaaactaacaggtggatataaatataaagaaaatacagtattttgttgatttatgttcatataacttctttattggtaaaagggagacaggtgagaatacaggaaatccttgtggccttgtttgccttttttagaaatttaactttgcaaacaaactcaggggaaactagtgaggtggaaataaagaatgctagactacgggtctggggcccaagtgttttattaatataaaaacttgcgtataaatgtccagtttcaccaccaaatcctttctgaaacattggtagtagatgaactaatgcaacaatttatttttctttgagacaggatctggagtgtggtggtgcaatcataactcactgcagcctcggtctcctgggctgaagcgatcctcatgccttagtctcccgagtagctgggattacaggcatacaccaccatgcctgcctaattttttttaatttttcttttatagagatgcagtatcgcttgttgctcaggctggtctcatatgcctggactcaagtgatcctcccgcctctgcctctcaaagtacagggattataggtgtgagccacgaagcccagctgctgcagttactcaaccagcttcctactagaagccaggcgtttctcaagcttctgaagacacaaaggtgaaccccagacaagccaggtttacagagtgtgcatttcagtgggggagccagccaaaaaatcagtaaacaccaagataaaatatattccagtggcgatacattttcagaaacaaacaaacatggcactgggctggaaatgaatggcaggggagaaggcgggcggggcaagctttggaaagcacgggcaggtaaggacagggtttcaaaggtgagaaggagctggcagtgtgaatagccaggggaaaagtgttttgggtagaaggaacagaaagtgaaacggtgccctggcaaggcaaagattattcattgctgaagagactatgttgcccagatgacttgttcatgtaatctgtgatttttaaatttagaattgaggtttgaagggaagtattgctcctttctttatctgcaatgggaaagcttactgtagttacttacagtagaagagaaatgtacatttctgaaaatccactgaggaagaaaggggcagtgatgattctaaatgttaataatgcagacagcctttgctttatgtatcaatttttgtaaatgtgttgcttaaatagatttttatgagccagtaatggtttagaaaggtaaatgacttgcccaaggtcatacacccagtacacttgggagccaaaattcatcatagatgactttgtgaaatgtcccattaaatgtgtatatatatatatagtgtgcattacagcttaacagacacacattcatttgacacattatgttttaactttattaataagtttttgtgggcataggtcttgttttgccaacttgacatgtggattttaaagggcaagtgccttagaatacaaactgtcctataaagaataccatattatcgaaaggatgttcaaactcatcagttagaggcgttgcagttggctgggtgcagtggctcacacctgttatctccgcacttaaggagtccaaggcaggtggattacttgaggtcagaagctccagaccagcctggccaacatggtgaaaccccttctctactaaaaatagaaaattagccaggcgtggtggtatgtgactgcaatcccagctactcgggagggtgaagcaggagaatcgctggaacccgggagacaggttgtagtgagctgagatgtcgccactatactctagcctgggcaacagagctagattccatctcaaaaaaaggcattgctgttaatacaacaatgataagttatttcacactcaccagattggcaaaacgttaagtactaaggtcataacaagcactggaaggatgtggagaaatagggaattttatgcattactgaactgaaacagccattttggaaaatattttggtattacgtaataaagtagtacttagcaacttatgcaatttggttcctataaagatgccttagagaaactgttgagaactaggaaaagctcaggaatgtttctggtgcataatttgtgatagcaagaacctgaaagtcctccaaaagccgtctacaatgaaatggggaaattaatggtggcacattcctgcataggagatagcagtgataatgggtggataccagaacgtgcatcaacacagaagaatctcagcaacataattcaggattaaaacagcgtttacagctgggcacagtggcccacacctgtaatgccagcactttggaaggccacagtcggcagatggcttgagcccaggagtttgattccaacccgggcaacatactgagaccccatctctactaaaaatacaaaaattagccagtgtggtatcatgtgtctgtggtctcaggggtctcaggtacttgggagactgaggagggaggacctcttgagccgggaaggtcgaggctgcagtgagccatgattgtaccactgcactccagcctgggctacagagtaagactctgtctcaaaaaaaaaaaaaaaaaaaaaaaagcatttacataggagaatatatacagtatgattcaatttatagaaagcttaaagtataggcaaagctaaacattcaggatatttgataaaactataaagaaaaccaagggaatgaagaatgcaaaatatgagctagtgttttcccaggtgtgagggacggggcatggttgggaggaaaacagaatggtgccatggcgagagatacacaggggaggtattggaaagttctgtttcttaaaatgagtgacaggtacctaggtagtcattctatatgttattaaagtgtacacacattgcttatgtgaagtcttgttatatgtggcacatatcacataatctgaaagaatctgcttcctgtagtaaaaattaaaaaaattatagccgggcacggtggctcacgcctgtaatcccagcactttgggaggccaaggcaggcggatcacgaggtcaggagagagaccaccctggctaacatgatgaaaccccgtctgtaccaaaaatacaaaaaattagccaggcatggtggcggggtgcctgtagtcccagctgctcaggaggctgaggcaggagaatggcgtgaacccaggaggcagagcttgcagtgagccgagatcgtgccactgcactccagcctgggcaacacagcgtgactccatctcaaaacaaacaaacaaaacaaaacaaaaaaggtttaagaaatgttctagtaccttgaaaccaaaataggtatcagatacttggctgttttgttttttcttcttagccattttgacctgtgagattttatgtgatgaaaacataagaatgtggtattacaccctgtgatttgaattttccatactccattccattctatatgtcagatgcatcttcctaaaacacacctttgtcacatcactcctctgctcaaaaacattcagtggctccctgggccctctgggactaagtttataatgctcagcttgtcattcctttgcccagtgtactctctgtctcactaatttgttcattattttaatgcattttcttgaatacacttctgtagacagccataagatgggtagcaggaatgctgcactgaaccataatccaaagctttcatcaggttcacttgcttcctgtccttgccacaccatctgctcattctcgatctccacttgaacacacttcacattctccacttgtgtatcattcactattcttgctacataaattaacacaaattttgcagcttaaaacagcacacatttattatttcatggtttctgtggatcaggaatctgagtatcagacttagctgggtcctctgcctagggtttcacaaagttgcaatcatatattggccagggtgtgttctaatttggtagcttgactggggaagaattggcttcccaaatcacccagattactagcagactttatttccttgtagctttttgactcggcctggcttcttgctgactgttggctgttggctggaggtacccctcagctcctagaggcatcaacagttcctgaatatctgggcttttcccacaaagcagcttccttcatcaagccagcaacaagagtttctggggcaagttggtcaacaagatggtgtcttacatgcccaatgtaatcatggaagccatgtatacctcatcacatttgccagatttctgctgattaataccaagtcagaagtcctgcacacattcaaagggaggacactgcacaatggtgtgaataccaggtggtagggattatgtggggccaccttacagtctatcagccacaacttgaagtatcttctctcctctttgctgccaaataatgtctctgaagactgtaagacctgaatcctatctaaagttgtcggtggttgcttccttcctgaaagcaacaagaagcccatgaatgtcttatggcctgaagatctgccttcaaagactactacctgtgttgtcacaaatggcaagatttcatcctttttatggctgaataatatttcactgtatatgtgaaccacatttttaaaaatgcatttctgaacctgaaggacattatgttaagtcaaataagccagacacagacagacaaagacatatgatctgactaacaatgtggaatctgaaaaaaccaagctcatagaatagaaacagagagtgagaatggtggttgctggggctagggggtcagtgaagtggggaggtgttgatctaagggttcaaacttctcgttaataataaaccagttctggagatctaatgtacagcatgagtggtgatggatgtgttaattaattcgattgtgataatcattacacaatgtatatagtaatcaaatcattactttatagaccctgaatatattcaatatttatttttcaattatatatatatatatatatataaatatatatatatatatatatatatatatatatatatatatatatatatatatatatatatatatatatatatatttaaagctgtcatggaaagccttaaagttaaaatacgaagatttttgagaaaaactttgcatattttaattgctgtctggaatcctccttcagctgggatgagaaaccatctctgggttagttctgtccctggaggtgagggccagacaacacatcaaaactgactttttattttttttcaaagttgttaagactatctaagattcagatctccctaatactgttcctagttagtatttagaacgtatttgtttagaggatactagcctgaaatagccctatctccaggttgtctgatgcgatgaggatgtggtgttaatcttacacctacccattagtctataaaactcctgagggatgctcaggaaaccaaaaaggatgtctgcatggaggacaagaaggcacaaatcgtctgatttcaccccatcctaagatcttgtgacttcagctttgttttggactggggcattggatctcccacatgccctctcttaagtcgtgcatttgacgcatatttaataagcacctactgtgtgccattagagaccatgatacagttttgaaagcctagcctgaataatggatgacaccctcctaaagccacgatttggtcttgattatttttagcactatgaagaaaaatttcattaaatcacaactctatttacttttaacccaacatggtgaagttatcaacatataatgcctgtctatactttcagatggaaaatgcctagataaatactgcatgggacatttttaaacatgtaaaaaaatcaattttcgtaaggttacatctttttacctctttatataaaacatgctatattaaaagagagattaaattttaccctgtggagtaaaatgcaaacacaaaattatttttttcatttttcagagcatgtactggattatcatttatttatgaggctttttttaatctagaatatatggaaatcttttcttgaagcacaatataatattgaattgggaatgttgtctgacagtttccctcttaccgttgcatagaatgactctcctgtatgaatttttaaaagaaacttcaatatgctatgcatttgaaagggaagaagtaatcaccataatcttgaggtatcttttaaataggcttccttccagttcttctatgtttcaccaacttttctacaacaaataatgcatctgtgatttttcagaactcacaaaatgtccagctttctttcttttattcaaaatttatacttcataattgaagttcacctcccaaaagacatagcttggtttagcatagagctatgatgtgttttctctttgttccttttgcacactttccttgtctggaggcgttgggcttggatccttcattcttcatgaggctgatgtttttccatttcggtttccttaagtggtgaagctgcacaaccatgaaagcagtgaccacataaaaatgctgctttgaggcctggtacctcatgcctataatcctagcacattggatggcccaggcaggagcatcacttgaggccagaagtttgtgaccagcctgggcactatagtgagaccctgtctctactcacataaaaatattagctgggcatgatggctcataggtgtagtcccagctactcaagaggctaaagggggatatttcttaagcccagaagattcagactgcaatgagctatgattgtgccactgcacttcagcctaggcaacacaacaagaccctgtcccttaaaataaatgctgccttgggtatcttaatcctttctcaagattccttctaaggctaacatttctttgccatccccacactaccatctgctcacttttatatatcttgaccattttatttttcatcccatcttcactccatgtaattagttagctattgctgcagaacaaatcaccccaaaattcagtgattagtttataggtagccccatttcacccatctcattctatagctcaggttgaaagttgagtcatgaattggggaacattcttctcttggtgtaaattagtcaccagtgtctcatagggttgggctgaaacttaacacatcccatcactttgattggctaaagtcagttacataaccaagcccagcttcagaagggaaattgtatgccttacaaggaggtgagaggatggaaaatgaatatttgctgaacagactttctgtccagtttgttgtatttggtggtggtgcagggcaaatatatgtttaaaaccttgttcagatttttagctttcttcagaacagagcttttaaaactgagcatttgtcccctaaattccagcactgcggccatgagtaaagggtgccctgaccacgagcaaatcatttagctggctcacctttcatgcaaccttgaattcaccaggaaggaagttcatgcagccctgggtatgatgccctaattttgagccaagccagctagagttcaagtccaaaccattccacttcctagctttgggacgatgaacaatttacttatgctttctgggctttggttcctaaattatttaaatggggatgattacatacattcatcattttcaccttctcaaagaccttctggacaattccccaattcatagctctgggagacagtgtgttgacactctatttgaccacatcttcctagcagtcttgcggaaggtgccactttgcgaacgatctgttgctaggtaatgtcaatgacatgactttcagtttagcacatgtacagatgaccttgtttgggcttgtgccgttggtaattcagtttcaggatttccgtttgacagaatatattcaagggtggtttcttgctatcagttgtacccttgtggccacagtttttccagataaccaagactcactaatattttcacaagaacatttgtcacctaggtccagatttcagaggaaaaaagtataccgccattgttcttgtataaactttataaaatatttggggaacatcactagccacctgcttccgaaagtacttagatactgtgtcatcttaatacaagacactatgcactaattaagctgttgttgatgcttttttgcctttttgacaattaaaaataatctcataccactggattagtctcttgcctttcaattttatgtttatatacaaatatatgtgcataccaaattttatatatatatatatatatatatatatatattttttttttttttttttttttttggtcggagtctcaccctttcacccaggctggagtgcagtggcgcaatctcggctcactgcaagctccgcctcccgggttcacgccattctcctgcctcagcctcctgagtagctggcactataggcgcccaccaccatgcctggctaattttatgtatttttaatagagacagggtttcaccatgttatcaggatggtctcaatctcctggcctcgtgattcacctgccttggcctcccaaagtgctgggattacaggcgtgagccaccgcggctggcgaaaattatatattatacacacaaacatacacacacgcacacaccaaatttaaaaagacagatacataggcagttgttatgcagtgtttgaaataaatttattgccagctatgggtcatttggaaaaagatcaatatgatgcatcaacataacaagtaaatggaaatgaatacaaccgcatggttttctgaaagcacggtttcctgcgcggcttccagaattgcatccctgacatttggaacatgtgttacatgctacagaacatctgtctgtgaacaggttaatgggaaaggtgcatctctacaaacaaatattacctgtaatgctgttgtagctttgttgattgttgatattacttatgaactttcttgcttttcagaaaccaccaccacaaaagaggcagtaacattagtattacattatacatcttaggcatttttttcctttgcccttttcgtaggtttttgtttgtttgttttttcttgtcagccacttcatcatgtttggtctctcgtctttggctgtgtttttctgtttctagttattgtgggtgttaaaaatcactttaatgattcagcaataattaggaagtccctatttgtgggtgttactttactaactaccagggatgaaaaggcaggttttgctttgttattacgtcacagtttcgtcaaggagataagtacttaaattgcagtagagtgtgacagcatatgtcgacggtgtgagtgatatggaataagagtgagacagggaggcagggcaggctccaaaggcgaagagatgtctgagccaaattgaagggtaaactgagttcaccaggcaaactgaggaagggtactcaggctgaaggatcatgggaggggaggagcgtgagttcctcttaagtgaatataaaccagggggtaggaaacaacatgagatgaggctggcgagagagaaggatgctaggtgaggtgctgtggtgcgccagagactgcggaagtggctttctaattaagaaacagaagccaggaaactcctgtacttcaaggttttggagtgggaaagttgaggaaatgtaagagatcatctctgtctctatcacattaccgacggagaagtgggataagaactatgtgtgttttcacttcttctttctttagagaaaacaaatatcatctgccttgctaggtagttgtgagaaatgaggagataatatctttaaatctcctacggtgatacctggaacatgatggtgcttgggaaatgtctcttcttctgaaatgaggctgcctcgaagactcactggaacccaagcaaagtgtctctgcatttcactccgagccatcgacttctgttctgaatgttaaaatgcaggtggctgtgagggagtcttctgagtcatgccagcgtttaaggcgcttgctcttctttgtgcacattcctgcttttctcaaagcctattgaaagcaagggccatgtttgctgttttctttgacagaggaaattttttttttttttttgagaccgagtcttgctctgtcacccaggctggagtgcagtggtgcaatctcggctcactgcaacctccacctcccaagttcaagtgattctcctgcctcagcctcttgagtaggtgggactataggtgtgtgccagcatgcccggctagcttttgtatttttagtagagatggggtctcactatgttgcccaggctgacctcaaactcctgcagtacagtattgcaccttcctcggcctcccaaagtattggaatatccggtgtgagccactgcacctggcctccaacagaggatttcagtcaatgctgagcaccaattacagattgattgcctctgtgattccaggtaaataaccttgttgtggagctgagtctttcatcaaaaacaaggactcctggcagatgcccagaggcatttataagcagtcccatcacgaacaaattgccaaatgcaaggcctgaacaaaagacacagaaaggatttctttatcgtaagcacacttctctacattacctttacaatccaacaactctggtattagtaaattatagaaacaacttttgtaacactatcttgtttgcagagtatatgaaaaatttgaagttaaaattcagctccacgaatactgcagtggtgagaaaatggcgacaaagattagtcttctgtgagaagtctgctaattattcttcatttaataatgccatgtatgatggccttcattagaatgaattcttctcaacacctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttattaaatgactttaatcatatgaaaatcagccatcagccttattagagtggttgattttttttttaatctaagagctttcttggttattttctgttcttaatcattgttgtatatccttaatgcgcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttctatagctgagaaaatgggttagcataattcaaaattcaattgctgtaccctttttcatatgaatagataatacagaatgagccttaaatctgggttggaaaaactaacaggaactggttttattttaattgagttttaaagcacttctaggccatctcattgtctttatagtttaaccctttgaagttgtgactgccaacgtgctagtcttgtcgtcttacacgttaatggtaatgatctttttagatttattgtgaacctctaggaatgttttttttaaccagtaaatgcactgaaacatggaatcaaagtctctttcccgtgggccccttttcattgggaataaatgctacccatagattgaagtagtttataccagtacattttttaggtgccttaacttaccaaggttatttgtcaggaaaattatctcttgtaacaccaggttccctacctttagatgacaggacttaatacaaaagttttccccataccaactagtagtgtaagttgatttcatatccttttatttcataaagttttgcttatcgggtttgtcatcctctatttgaaattaaaatgtgtggtctcgagatgaccttaaagtatctgacccccaaatctaatcactcctagcatctgtgaaaattgacaaatatgtcaggtataacttggggcatcaaaacattgttttaaatatttcgtttgtagacaaggcaaagatcattttcaggttagtcctctgagaaggaacgctgggtgcagaagcatctttggtttctctgctctataatcggcactcattatctatgggtttatacgagcagaaaatgtacagttatatgttcagcacaagtgaattattgattggatttacggccagaagaatgttcctaagtggtcaatacatggccaaagtgtgtcaggtgaaggtaaaaatcaagtaagatctatacttttgatagcaattgctgttggattatgttacgcttgtcatctgaggttactgttgaatatagataaaaatgttaattgtattaatttagacaagaatgtggcttcaatgagtatttcttacaaagtgggagtatcaatttttcttaaatgtagagatttagtttttcaaaaattatattttttatatgacctgacgttgattggcttgcctacattctcttttggtgtatgatgacagtttaaaaattcggatgcattttgcacagaattaagacgttatgtgcaatccttgtgtttctaattatatgttgatcaatgacacctttacaaaactgtcatcagtctattggtggttgattggtccaaccttagcccgatacctctatctccgcttagtcattcctggtgggtgactgatgacccctgcttaacagtaaacttgttatgcatagggttgttagaaaagtcttcatcaatttgagccaaactgtggctcccagctacttccatcaggggtccttattccaccctttgattgcaaaatgccctgaagacctggtatgtcttatgtcagttacaagaggcccttctagtgatgtaccgggaacctcctatgggaaccagagctctgctaattttggggacaagaaatgatgaaaagaagtgccttgttcttggggcatcacagtctcatgacagagtgcatgttgtcaaatgcgcgtttaatcttcttaagctcaacttcatgcaagagacctaggaattcacagagtgaagatgatttctccattcccttctccgagcagagctcttgaagaagatgggagttaggagaagtgaatcttttgttttcgaagcctttgtccttgtgagtctcttaattggggtgtcttgtaatgcaaagtctttaaagatgtgtgttcctgaaactcaggaggctgctctatcccatggttcaaccaaagaaccagggccaaagcagtgctgaaggaacaactgattctcttggccctccttagagtgagggtacaactggctccaaaggaaatgttggcacttccagagtaattctgacagtactcagatttgcttcatgtacccattctagaaccttacctactcaagtgtaagatgagatgccactgtggtatcttcaaaggaatttagaatcatgtcttaatggctccattaagaagaattctttttctcttttctctgaaaagcatcccaggtcataaaatgtaatgtgggattgtaggttttgtgggaagatgcacttggcagcaattccttgagaggaggccttgaaatgtcagggtcccccattcatcttcccaagctgggattgacccagtgataacataatgataatgcagctgctttcaatgtcaagccatcaggcagcgggttgggggggttgcttggcccaggaacccgtgccctgatgtggagttggtaatctagagggttttgagttaagtgcttttgacatggaaaatcaggagccaagggcgaagctgccttttaaatgctctttctgaaagagtccactgcagatgtaattgagcctctcaggtgaagagctttattcgagcaaagctggttagtgttgcatacctgtttgggggaatattttaggcatcctcacaaaactgctatgtgacattgctgaaggtccccagcctccttgctcccaaacacttcaagaaggaaaatgctgttgcagaaatgttgtctaagctttaccattcagtgtggcccagatcaacctgtcccttctttttgtgatcacagtgtgtaattataaagttatttgtgtgtttggtttatgtcttccacactggactgtaagatccatgagatctaggaccacgtctgtcttgatcatttctccttctctaagactaacacaaggcctggcataatcattgtcatcaccatcaccatagctagtatttattgccatatacagttatgtaaaacattgtaagaagtgctttacatcagttattcccaaccatggagtcatgagtcaaagatggtcaaattggccaagatgaaggtgtttgcattttggagaccaagcacttgaatccataaccccaagatgtgactttccaggcttgggatttcgcaacacgtcgcttaatctcttagcttacattttgtcatgagtaaaactgaaacagtaattcccatgtgctgagtttgctgtgaggattaaagacaaggactgttctaagcccggcatataacgggagcccattataagtgaactgaggtgttattttaatatataccttttaaagtttgagtgttaggcatgctgttgagtgaaagaagacagactgttaccagaggacatattctgttctatgataccacttgtgtaaacgtgaaaagcaggcaggaattttccatgtgagagaagtcagaatagcagttagcttaccagggggtggtgatcttaaaggggcaggaaggagccttgtggtatgctggaaattttccattcatctggtgatgtgatcacttggccgtgtgcacgtgtaaaagttcaagctatatgcttaatatttgtgcacgtcggtgcgtgtaagcaatatctcaaaacatttgagagaatttcccattcattgacagaatttttctcccgcctcggtcaaagcacacagtgggttttcccaacaactgaggtgcctgagggttgggtgccaaagaggcagaaaggccgagatgaccgcttgacctaattccctattcagctgaggcctccacccctggcctgttcaaaggcagttacggatcttttactcaaaacctgaacctaaaaagaaattctttagccatgtccgtgtgaactaaattcagcgtcagatgtacaaggctgtggttctgaccacccccgggctatttctgaccacaggacagcttaaatggtgtggcccataaaatgtaatctgcaaactcaggctgaatgttgatctatttagggccaagagaagaccaggccttggcagcagttctccctgaggtaggatcttaggtcgaatggagaccatcaccctggctgccagccccaggaggctggaaattcgttagcattctttatctttggggatcggccacttacttgtggggttgactcttacagcctttgaccacctcccaaaagctggattcactgatgggcccccaactcaactttcactggccaaagtacttggggttaatttagcaaaccccaggatccccagagggtccctcggtattgtggttttctcctcgcttccaccttatagtggctccaccaggacctcttgactcagccagcactccttctcaagtcacttcgcagcacaatccgtttgttgttgctgttgttttttcttttgttttgttttgggtttttttttttgtttttttttgttttttttgtttttttgcctaatttgtgcttggcttctccacagaggcctggttctggtcccttcccctgcaaccccaaggcagggggcagattcccgtatcatggtgctccttggcctgattctgtggcctttatattagaactcaccttctggaatcttttattgtcttgttctctcttccaagctgcgcatcttccttcccttcagaggtttggtgatcagcgtggtggctcgtttctataatcccagcagttttggaggccgagactcggggatcccttgagcccaggaggttagagaccagcctgggcaatatagcaagatgtcatctctaccaaaaaacaacaacaacaaacaaacagacaaacaaaattaggccaggtgtgatggcttatacctgtaatcccaacactttgggaggctgaggtgggaggattgtttgagccccggagttcaagactagcctgggcaacatagcgagaccctgtttcttaagaaaaaagaaacatttaattaaaaattcagaattggaagttgcattgagccaagatcatgccactgcatttcagcctgggtgacagagcaagattctgcctttaaaaagaaagaggtttggtgccaggacgccatgaaataattactctaggtaacctgaggctagacaaacctctccatgtctcagtttccttcctggcaaaatggggaggtaaggccagatttcttctcctttagttttgtttttctacttgaattctatttgtcatcctctgtacctaccacctgccagttgctgtattagatgctgttttactcattgtctaattgaattctccaacaaccttgcaatacgcttgttatctccattttagaaacgagaaaatggtgactcagattaagaaacttgctcaatgtaaccaagtcacaattttaatattaaaaataatgagcatttattaagtgcctgttgaatgtgtaggattttgctaaatctttcacataatctcatttcatctttatcatagcccttatggtgaaaatgccattattctttgacatagaggaattttgattcaggaaggttaagtaatgtgcccagtatcatctatgtataattgatgggtctataatttcagactcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcaccctgttgcccaggctggagtgcagtggcgtgatcacagcccactgtagccttgacctcccaggctcaacctatcctcttacctcagcctcttgagtggctggaaccacaagcagatgccaccatgcctggctaactttttttttttttttttttttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctcttacagatttttatcatcatcccattcataattgattccaaacgtgcatgaatctttcaagataagtgtcttattgattatcctgaaaacaagcgatcacttggtgtcctgagattcgctcactgccctcccctgattaccgtaaacagagatgttgatgagaagaaatgtcactttctttggtgttggatccataggacattttgaggaattgggtgtggggagtggagggagtgaagtgacccagatagggaggtgcttgatggcttgactgtggccttcaccttgctttttgtggagctggatatagacatttgttggccagctaatactgtcttgatctgttatatgatccttaggccaggactttttcctggtaattgtgcaaaatgtcccagtgaatgccaattccttgctgtcaggaaacattaagtttcctaagtgacatcctttttctgcatgtttacttatggttatgtaaatcaagcgggcctccccattggaaatgatggcagtggttacaagggacttcacctggtcttttgtagttgtggcaaatagataagatacaaatgtgacctgcaattcagttcagcattatgaagctgtatctgctccctgggtggtggtcacagccctgctttgtggccctaacccttgccttcctgctggcgggccttgcacaggtgcagagagggggttagtattggcaagctaattggataaatggtgaagtttcccctgggtggctccattgctccaggtgaagctcttgaaatactctgtagatgacaatagcctcaaacttgaacaggttcttgcagttggcaaacagaaggagaccagactcataggttttgggtgcggataatggataatctggctattgcatttaattcccagcctgatttattgaggctgcctttggtgaaatattgatttatatcttggggggccaggatggggctactctgtactcagatgaggcttgctctcaggaagttcttgttcagcagcaaaaatctgccctgtttgggctctgaaagttatttttgtagtggcctcacaagtttcttgtagcaggtcatgaagaggaatgaaatactataatcacagagcttgcagaagctgcctggaggaccagttagtctattttttgtacatgaggatactgaggctcagagaaagtgaggtcattgagtcacttgagttcttgttgagtgttctttcctgctgaggtgtcctaggtgcctcttaatgcctttaacatctgctaagagtatgtcacttattgacgtagcatcactttattgagcagctactatgtaccaaacacttagcatatgctttttggcattaggagctgaacccagagtggtctctgtggagaggtgcaggtttacccagggtggtggtagtggtgatggggtggtagtgatagtgttgatagaagaagaggaggaggaggaacttctcaggaagaagtggcagttccctcctttgtttcttatctctactgtttagcagccactctccaaagcctcttgctgggaatgtggccatcatagaagtaaatgagacatctctttcatctgcaccaacctccttattaagaccttatcagttacctgtagattctcccactgttgtacttgtttctccctcaaccaattgtattttagctctcaagttttggcagggttgagtctagtatttctgttgggatccggggagcatatggagtgttgtttgttattttttagagtttcttattgcggtaagtgctcaggagggaacagagggagaaggatagaggaaaagcaaagcaaaacaaaatagaaaagcacaaatgaagaatatttagtccattctgtattagtcctccttgatggggggacacatgccagccaggttacctgattcatctagttgtgattttattgacagtcatttctaccttgttggtatccgcagaggttgtcttgaagggggctgatgccttctttcactagctttatgtggctggcagttctgtcctgccactcttttcctcatcatctcagcctccctgcccatggcactcaagagtccaccttggcagaacctgcaactcttcagcgcctccctaatgaactccttgcaagggcccttggttaagttacagtagagaagtggttgcttaagcaagtagtttccggtaaaggcataaagatagcccataattgggtgataaaatacctggattgcatctaaaaataaagacttgtgaaggtaaaactgtagcttacagtgtgcgactgtttaccttcttttggtttcttctcatttaataggttggtcatctctctgctggctttttcccccttttttctcccttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctagtttacctgaaggctatggtcactcaacaaattttgtgttgcttcttacgtgtcacgcactgtgataagtcctaggattatagaagtcaataagctatgatgcctatccttaaggagagaaacacatataggataggaaaatagcttgccatgtctgatagatattaggcattcagtctctctctctctctctgtttattatagatagaaataaaaaaattataaatagaaatttatttctcgtggttctagaggctggaaaattcaagatcaagatgcagacaggcttggtgtctggtgagggctgctttctatccttcaaaaaggcaccacgttgctgtgtccttatttggtggaagcaagtgtgttgaatattctaagaggaatctgaaagtgttatagtattaaggaagacagatccaagatggtggcaatggtcaagaagggtgcgggaagaacccttcaactctaatattatttgagctgctcactgataaataaataggattttcccagttggggaagagggaaaggtttttagggagcagattagacaagaaacattgaaaacacaaagtgtatttcttgatacttgttaacactaggtgttgaggagacataaccaagttctcctgcagtttgtgtgttaaggcagatggaaatgtcttgtaactcagtaaaacagtttagaaatttaaagcctttggagagagtaagtattgagaaggcacatctctacgttgttgacgtgaaggagttgcaaggtcgggtagatgggatcagtgccaggtctaatgggcttcatttgcaagacctaatttctagcagatcatggtgtaagcctcaaatgggaggtgtgcctgggatggttgcagaggagttgttaagagctcagactccagcgtttagacaacaccagctgctacaaaggacactgtgcatttctaaatctgagtttctgcacacgtatggaggagtaatatggcacctcctcatttggttgagatgctctggggtacacgtacaaggcgctcaactcacggtggctccaccagtatgaaaatgtgttatctgccctagtctgaagtacagaagtcaggtggtgagaggtgacatgccatgatgtggttctgcttctctgagattgtctgtcagcttttccctcagtttcacccccctttctccctttttcaagatggttttagcacttccagacattataaccagatagcctattgctagagaacaaagcaccttctcttcctatatgtacctcttgggaacaagggaacctttccccaaagcccctcaacacacttaggctgacatctccttgaccagaactgtatcaaatttacatagcctcaaatgaagcatctgggaccaccaggattgggtgtttaggccatggaagagtaacagcccagtacacaactgtctccagtggccagcacgtagaccttccctcacactttccactctctgcatcccctcttccctctcatgtatctctattacatggagcctcactttatagtcctcattaagagactgtggggtggtagacagataacaatgttaacatcaggcaaatgggttttggatttaggttaccatcatttatcttctctgtaaccttagacgagttgcttgagttctctgagtctcagctgaccaagctctaaaatgagcataaccatatcagtttgtgtttcctgttacagggagaaaagactgagataactaaagtacctgattgagtaactgctctctgaaggtggaggctggactgcttcactggacagggtggcctggggttattctagtgcagtggtagctggtgacaaaactcaaagaagatgtaactagagaaaaggtactcagtgcagcctctgtgagctaccaccactgcctctagttttccagaaaaccaccactgaccactctctgtacagatgcgctcaagcgaccataaccaccagtgttcctaacaatgcgcctattgacttcttatttcaatagatatccagattgattatccctcaaggtaagcatcgattttacctttgtctcagtcaatatttacctctgaggtcaatacgtgtggatattcacctcagctgcagtcaatatccatttcgtattacaatatatgatgtgcatatgtgaaaataaagaacagcatggtacaaaaaaggtctgctaggcaaagaagctttttgcaaagcggatgtgtttttgttttattttttgtttgtttgtttttactgtgtcactttttagaggtcagattctatttcactaaataggacatatgtgtcttctgccaagatgtggaattttggcaaggctagcatgataacaaataaacattcaagcagtcacttaatgatattgaattgaacaccatttctcagaagttcctgtattaaattacaaccataagaacatacacaagcatgcagattgtaagtgtgatgagaatggaaacattccataggacgcagagttattcctcaagcccctggactcgcagagaatcaggtgtatgaagcaagaggaagaagacaagaatcaggaggcaaagagaaggaggaagaagcctcagtggggttgcttctttttatttcttagagccagagctggaagacaaggcctggcatattttggcaggcctggatcagagcctaggtgtgtaaattaggaattgcatttcgctgctgctaacaaggacccaaacatggtggtaaattcttccacataaaacaacagaaaataagttgttttctggccctgggctggggtggccactccaccgtcatcgatgatccgggctccttttctctttctgctttgtgacattgcttctatcttcatgataactcgctgcccagaatgaccaggcagcatgaaaacgaaaaggtggagagggaactaacttcttcccttttgaagagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggagtgtatcctgattcttttgaggatcacttgatcctgattttttttttatgtgtatagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccatcacccttgtactatcccattttcctttgccatgcacctgtcttcctcttcaggattgatcacaaaatcaaaaccattcctaccagccagaggtgggcacatgacccaggtcagaccagtcacagttcctgattcccggccacagtgcatgatgggggaatgagcatatatcaaaccaggacagtccaagtccttccggggactttgctgccacagttgacagggggaggtatttgcataacttcaccacacacagctaagctggtgatcctgctgcttggcagcatcttcccagcgtacaacagaggaaaactgcctgttgtagttaaaaaaaaaaagagagagagagagagagagactgatacacaaagagaatcagaaaggagtagagatgaaacaaagatagagctagcatgattgcaagctgaggacatacgaggagtccctgggtcagctgggccatacatttgtaagctgtagacaaacaaaaatgatctttgggttccttctttagcaattggagttggaggaggatgaccttagtttgcgtctttgtcccactatcattatatccaacttgtgtaattagaaacactatttaagtctcagtttcgtctcctgtcaattgggaaaatatcgtgaggcggagatgtgagatgtgatcacgtttataaagtctgcggcaagaggatgataaagtcacttctcaactccttctcaactcctcctcctggcttattaatgcccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgctcatattcttgcatttgctgcagcaaaacctgacctctctttgtgttacctgagtcttgacgaagaagactgaggaaaggccccccccccccccccgccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctgtatttctcagggcagcgtgggacctcagggtttgtcatggaccacacctttctcctttgtccctttttataactcataggctacctccaacttgacacttatttaagtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgtggaaaagggacatggcccagggaaccagagtggtttgggaaagcactttgtcaagaggcttggggaccccagggtggaagctgccatgcgcatgaggctgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtctttttttttttcctcctttttcctgaatatggaaccaaagcctgtgtttttcttgctcacatgtgagtcttctccttgcttcaaccctccccgctgacagccacaagactcctgcctccctgcagcctgtggaacgtaatattcgttgggatcatacattgaccaaagatccgccatgtctttgcaactaacatactcactcatgacttcacgtggctatgtacaagaccacatctctcaatggtgaggtcctcaatctctccctccccaccacagttagctatcagagatatacggtgtccttaagatagggcaggcagggccacctgccccccagctgaccagtgtggatgtcttgatgatgagccatactcagagtggccctaggatggctcctcagatagctgctggcagaaacctgcactcagtacatctatacatggtgtaatgattgactcaagataattagcatagccatcatctcaaacctttattatttgtgatgagaagattcaaaacccgctttttgaactgttctgaaatatgcaataccttgttgttaactgtattcacctttctgtgcaacagggcaccagaatttatttttgctatctaaaatatcaattaaaaatacaataaaactaaaaagaaacctgaactcaggagagtggaaaagaacttcaacattcaaaggggataagacatatactcagagtgggaaaaatactaaatggtaggaagatgagaagttttttactctttgttgtttctgctcattttttatattcaaaatttctaatcatgtgtgactatatatgtattatacatggtaggacttatttttttaatgtgaaagaatataaaacaaaatacgatattatcttttgagtgatatcaacaaaacaaaacatgatatccaaagtcaccctgtatggttggatactttgggtttgccatcttttcttttgttcatttgtttcatgcaatagaaacgttttgagatcctgtctggctgggttctgctaggcctgggtctacagcagtttgctgtcaaggtcttggcccttcaagagcatgtagtgtggtggggaaggtgtacatcagtgaagaggtaatccaggtcacggtgggatgacacaggctgctgtggcaacccacagcaggaatagccagtcctgccccagcagggcgtatcaggggtgctaaggtgacttccaagattgaggttggcgagatcgtgacaggtgtgcaagatggggtgttccaagactggggacaggacaggtgtgcaaggaccagccagctgaggtagaggaaacctagacctatggaacatgctgatttcaaggtccatttgtggggagaacacggactgtgtcattggaagccagcagggagaatcagttgagaggtaagccgggcctagtagaaagtaagcgaagccctttcattaagtgaacgaagggtgcatggtgagtacacagccatgaaaataaaatgatataaatcagcacggtttcagctgccctcatctttctactgtgatctcagcagtgatggggctggctttgagggttggagatcacacacacacaatcagccagctctccaaagcaagccccacactctcttgatgctatcctcaataaacatgcggtctaaacagtaaccatgttctagctatgcagatgcagtttaaagacaaatcctttgagcctccagcatgcgatcccctcccaatctcattgctgctcccctaccctcttctgcgtagaagcgctggagccaggtgcttacgacctgggtgctagtatctttgtgaaaactgctcctgacctattgctttgtttattttagccggtgcctttgtagagggaaaacagcttagcaagcatttagtaggtagatccaaagtccccaggagctgttgggaagtccataggtgctgtttccattgctttttcattccttcatatattaatcaaggagtcagtcaatcaattaaacggatactattagcacctactgtgtgccgggcactgtacttggggccatatgcactgctgattcattcatttggattctacggtggctctttacccattgccatcattttgtaggcagtgagtgcccgcatcagtgggcgttttatgttgcaccattttctgagcaatgtctttggtccaccattaagcatttgtggccgcccaccccacaatatgctttgctttctgctttcagaaacaatactggtgacctgttttaagaaaagctgaaaagccaggacttagatttttctggaaaccttcaaattaacctcattaagtttaaaattgtttttttctcgttcatctctcttgcttttatgctttccaaacccctaaattgtggtgcctcagtgatcttctataacataagttgatagtcaataattgcttaatgggaatcataaatatgagtttatttatatgtgtatatatatatatatatataaaatatatttccatgaatatactgaatgctaagccctccccactttttttttcttttttaaattcagaaatttctagttgtgtttattcccctcgtcagcatactttatcatatcagagccttttcagacactgtaaaactactgagttatgtttgggtcatgttttgcggtatgccctttaatagtgtagctttagaaatgcaattttcagcctctgcttattagaatatgataaagtattcctggtctatgtccagctccactaatctccagactgcgcttcatgaattaagcatgaagattttagtcaatgtgctttcaaagaccaatgtttagggaatcatggattttctacaagctgagggagaaatctataataggaggaactgattttcaaacatcatattctcaagaagaaatgaccacttctggcccagaaacagaaaatatttcactatcagaattttctagaaccagttaaaaccacattgtgctgttaggtttaataaacggattgtgttttaagatgtgtaagactgtctgtcacgtgggaggatttcaaatgactgcttattttggaaagctcatgtagactgggttaaaatcgagaggggaatgcaaattgaatttataaggtattattaacttcttcctctttccccccgccctggcccctgtgcattttggttcattttgctctgatacaattcagcaaatagccagatatttcttgccatggcgagagcttagttgggggagagattttgaccaggcaggctctcaggtcggtgccatcggtgacgccaacacacctcctggcttggtgtgttttgtggcatttggcaggcaaacgttttgaaaagaaatctcctttcaaaaatcacagcactggttgaagcaggagcatctctccccttaaatgcaaaaggagttaatatgccagtgactacagtgtgcctggaaaggtcactggaggcatttttgtctggggcagcccctggagtcttggcttttgtgcttggtgagaccttatctggcctcttcattgtccccttcatacaaatagatagcttttagtgagcagctactctgcctggcactgttctaaacacatgacaccaatagctcactcagattcccgcctctcaacagggaaactgaagcacaggaagtttcagtgatgcacttaggcaaccagtaagtggcagggtcggcattgaggtcaagactggttggacccctaagtttgaacaatcaaactggactttggggctcacagtttgtttcatgtcaggaaggtgtccgatcagaacctgaatgccagctcaagctgctctcagctaaactccaggggttgctgatggagacttcatcccctcctccagtcccgggatcaagacagaaatgtaaatcacctccaagaatgggtctgcgtcttgcacattttccttttgagaaagaggaaaattctcagctggtctagctttgtctgtgaacctccgggatctctcaggggctttaaattaattaatcaatccacagacattgaactgaatctccaccttgggcttgagactctgcaaagtgcattaaatgggaaggaaaccaaagggcctgctgccctgcccccgccatagcctaaggctgtggccatggctggggaattggcctgtcagttcaatcaggcagcccctctgactggtgtttttcactaagctggccccatggatggccctggtcatgtgtagacatggcctcaggagggccacattcctctcatttccaggcctccccacttaattgttcctgacacagtttggggagaaatgcagcaaaacccaggcctgccaatcaacatttgctcccgagtctcagagcggcccctgaagagacaggttggaccaagggacatccacagatgccttgtgtttaggaagtggggtgtgggcaacagagggagaattgttacccccgggagactgggggtgctgaagaagagtctcagtctctgcactctgggtcttgccaaaacctctgggattgggtgtggtgtccatgttgaggaagggacagtgagctctctaaatgacagtgggtcaaccaccgcatttctaggactcaaagatgccgtgggggtgtattagtctgtttccttgctgttgataaacacatacctgaggctgcataatttatgcaggaaagaggcttagtggactcacagctccacatggctggggaggcctcacaaccatggtggaaggcaaggaggagcaaagtcatatcttacatggttggcagcaggcaaagagtgagcttgtgcagggaaactcccccttataaaaccatcagatctcgtgagacttgttcactatcacgagtaaagcacaggaaagacttgccctcatgattcagttacgttccaccggggccctcccacaacacatgggaattgtgggagcgacagttcaagatgagatttggatagggacacagccaaaccatatcacagggtcacctgtaggttaccgtaaataagagaaacagaccaagtagagactcagcatagctggagggggggccccagatgacggaaacagccccccagctccagccatttgttactgggttgtttccaacagaatcaaggactcggatttttatgtgaagtcatctccattttaagtattcttttctttccccccaaccctccgtgggttaaagcatccatgtttacagaatgaaagatgagggcaggataccacttctcctagggatcatcatcattttgtggggctatagtccagagaggtgaaggacccatcttgtgactgcacagctaccctgtggcatgactgagactataatcttctggattcttcaggaaaccctggtagctgatgaaactgccctagaacgacagcaagacaatagggccatgaaagcataagccctgaagtctggacactgagagaattctaggcttgacttctctgtacagccatcttgggagtgctcaaccctttgaatcggatgtctagaatggactcagatgtcactgtgcaggtgactcacgcctagaatcctctgcctatcgtgacagggagaagcctgtgtgaccctgtggccatctcagtctctgcagggcatctgtagctttggaggtacctgggcaagagactgcctttcctactagagcttctgccatccctctgtcactatttaaagcattgcctgcaccctcaacctcgttcagtttccacataatacctggggcagggatgtaaataccctgattttatgtgtcaggccttcaggactcagggtgtataagtgacatggctcctcgcacagcagggatggagaggcaaacccaggttggcctctctgccactcatatagaactcctttatcaccaagattcctttcttcttcagtgccacctgccttattttactcacccagaaggaagccgggtccctctttgcccctttgggtgtttgtgaaaagcaagttgcaaactctgaattctataaactgttggagacagattctggagagacactcaggcttagctctagaaagaaacgggtaagacagaggaggttcagggcaactgtgttgccttccttgactggtgcatgggaattccccagcagagagaaaaaaaaaaaagaaaggaaaaaaaccagaaaggagaatagaatctattatctccaagccattattcacacacacataccccaccgccattttccaaattgtaaggtctttttatataagcactttccgttaaaggggaagaaatagctttacccgtggtgtaaaatatatactttctaatgtaaatcaagaagctatgaataccataataagaatgtggtagtatattaattgatggaaattgtagagtggaatattcataatcagcagaagtcttttctctggaaggaacaaaggattaagttagggagacagtaatggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagtgcagtgtctgtctaacaataaattatagagtcaggcaaacaatggtttcgtattagggatataatgaaatatcttattaaaatgcagacttccttaggttcctgaaattagagtcttattttaaaatgattctgttgggcttattacacgcttttgaactaatcacactagtagaatctctctttagtcagagcatagaggactgtgagagttacctcttacttcagtattttcccattcgtattttattctcctgttctcttctggatagatctggatagattttttttagacagagtctcgatctgacagccagactggagtgcagtggtgtaatctcggcttactgcaaccttcacctcctaggttccagcgattctcctgcctcagcctcctgagtagctgggactaaaggcacgtgccaccactcctggctaattttttatatttttagtggagacggggtttcactatattggccaggctgatctcgaactcctgcccttgtgatccacccacctcggcctctcaaagtgctgggattacaggtgctagccaccacacccggcctcttctcgatagatcttatttggctgacaacgaaagctgttgtgctggtagcatcatccctttccatgcaaaagataaactgaaatctaaagtagccatatccttccggccaggtttttcaagtggttactctgttctgatcattgtcatgacaggaatagtgaaaataacaataaatcatttttctttaacgatccatttactgtatgctgggcactgcacaaaatggtttacatggtttatcttgtagcgttccatttaagtctgctaagagtagatgctatcattctctccattttacagataagaaaattgaggcttagagaaattgagtaatttttgccaatcctgagacttgaatctccgctctgtcttctgcatacactttttacttgtcattgctgattagctttctctttccatctccctgatcagaaccattctgcgttcttagattcaacaaaatgtaatactccaccttgccagtatctagcgtgttttcagaaattgtgaacggggtggaggtggagtactaactgcaatcagatgttttatttgtttatttatttttccttcttgcgttgctcttaagcccccactcttgggcaaggctctgtgctatgctgttttatgcacatcatcttctaacagcttctctgccacacctggagaagtgccaatatcattttcatggcacagataaggcattggatgctcatagtttaagtcatcaggtggtgactggaggagccagaaggtccctttgggcctgtcctctcaccagcatcaactgcaccaaaaagatctcattctgagtatcagggatgaacgcccccactgggtgatcaggcaaactacatgcattttaaaaaactatatcctgctgggtgcagtgcctcatgcctgcaatcccagcattttgggaggttgaggaggacggattacttgaggccaggagttcgagaccagcctggccaacatggtgaaaccccatctcacctaaaaataaaaaattagctgggcgtggtggcagccacctgtagtcccagctactcaggagactgaggcaggagaatcgcttgaacccaggaggaggaggttgcagtgaactaagattgtgccactgcactccaacctgggcaacagagtgagacactctcaaaataagtaaataaatataaaataaaataaaaaatatgtcctgtaatgaaattgaaagagaacactttgtttcttatctagttggaacaagtggggtggggacagacaagtgactgaccactctccatctgactcagtgtcagtagactctctcaaaaattagaagctggctgacatagtggctcacacctgtaatcccagcacttcaggaggctgacgtgggaggattgcttgagcctaggagttcaagatcagcctgggtaacatagggaaacccttctactacaagacatagaagaaaattagttggccatggtggcacacacctatagtcccagctactaaggaggctgaggcggtaggatcgcttgagcccgggaggtggaggctgcagtgagctgtgatcacgccactgaattctagcctgggtgaccgagaccttgtctaaaaaataaataaataaataaaattagaatctgaattttgaagacacaaattcagatgcatgtggatgggcccaaaatactttgtttacatgtactccaaatgtaactcctggggcacccttccttattttctctaccacaccaatgccttcatggtcttacatcttgtcctcttaaccctgacttctctagccctcatgaatgctttagtgtggcagatgttactgtacatgggccctcgtttattcagcaaatattcatggagcccttgtaccaagcacggtgctgagtgatgctgtgagggtgagcaaaagagaattgtcatctgttaaatcccagaggtccgtctgtgacaaaactttcaccattcttttgtaaaaattagaaaaatacaaaatagtgagtttttcatgagctacgttgtatcaattttaaagtatttcttttaggattctattatttaccctttttcttcaatgttaaataccatttcctttaataaagatttaaaaaagattccttccttccttcccccctccctccttcccccctccctccttcccccctccctccttcccccctccctccttcccccctccctccttcccccctccctccttcccccctccctccttcccccctccctccttcccccctccctccttcctccctccctccttcccttcctccctccctccttcccccctccctccctccttcccttcctccctccctccttcccttcctccctccctccttcccttcctccctccctccctccctgtcttcttccctccctccctcccttctttccttcctttctttccttcctttctttccttcctccctccctcactccctccttccctttttccctccctctctcccttcctcccttcttttctttcctttttaaatgctgattttgttttctttttaaagccctcagttggcaaacttaaaagttgttaagtctgtgttagcctggctagctttttttttctctactagaccttcaaagtctaggaatgcctgatgtatctgtatcctgtgagtttgccacttcatgatatttgatatgtcattgtttccccataattttttcattgttagcgttgtctctccagcctcctgcttcctcttcctctgtctccctcatggtgtgtcttgctcaggcatgtcttatataatcaatatttagtgatttgacttcttaagtccttaaaaaaaaaaaaatccaggtgcaaaacacaaagacagggctcatgtcaagggagggaacctcgctcttctactctcagtgaaagaaaggcaagaccactccagcctattttttttttctttcccttggcccttgtcaaaagggtagccagttttctgttaccattgtgctaactgaagaatggaaaatatgcccagagtttaaaaaaaatcaaccaatgcctgccctttctagagcaacctaattaacaacccaaatgttaaaatttctttatttagaaactcagctatccagaattacaactccgcctctcgtgcttggaggcatagttctttgtcatattcctgagtgtctacagatgatgaaaatagccagttatctttgcccttcatggaaaggataggaagaagctctgatgaagcaatgttggggcactcatggttaaattgaacctttcccctggttaagtggagtgtgtgtgtgtgttgttctttttttccagcaccatatttggccctataattaatatgcaagttcaaatacctcttgcatggagcaagaagctgaaacatgcgcatttgtaatagactcagcatctgaattgaatgggcagctttggctggagtagtactgcagcttctcgaatgcctattgtcaaaatatatactagttaggagacacattctgctacgagggatgccctcccaaattaaagacactgttcagtttacgcttaacatttatggctatcaaactactagtccacaaccaatcatcatggtttcgttaacacagtcaaaatttaccactgggctattattaaaacttaatataattaatgtaaaaacacatacttcttttcaacaaaaactggctctctttgtagtctcttttttaatttggtgcaatcacttaaaaagtttagcacatttaaaattttacatcattttaaaattgtttctcttttataagaaggatgctatttactattaatgtagaagtacaaaggaaacggttactttggatttattcttttggaaaattagaatgtgggctacatgcttttcagaagttgatgaccaagagaagaaagaaagaaaaaaaaaagggtgcttgatgccctgctcctgctatgtccgggaatttcttgtacccttcatatgagcccctctgaacaaaagcaaatcctgttgacctgtcagcttaaaaagacaagaaatatgccacattccgcaggaataaggagaaaagaatggtgcgaaaatcagtgacacgaagttgaatatgtgaacacatccagacaaatgtgaagccagcccgattaggacgactgaaagggcatttccccagaattgcagttttttttttttttttttttttttaaataggggacgctattgtcattcagaaagccacaggctgttctgaaaacaggcaaaaatcaatagcccacttgttgaggataagtgaattagcctgtgttgaatgtaactgagtacctgaacacttgagtgggcagggattgttggggagaaaagacaattgtcttttatgtccacagcggttcacatcgctgattaattatgtccaatgatcatttttgtgcaggactaatgggcagactctgtttttgtttttgtctgtctgcccacaacctggtgaactgaatagagttccccacttctcagaacaatgcaaatggtggccaaggggctgtggaagagttgccagaaatggaatgattcagattggatgaaaagttgattttattaattagttaaaatacaaaatgagaaaacagaaaacacaataaatacacagttaataaaatacttcatattttattataaaaacattaattactttaataaagcggtttatattttcaaatacaatatttaataaactatattaaaaatatatacaaaatagttgtaagaatcggggctcctgtgagtacgtaaatgaaatacgcttacatcatttacttctcttcccttttgtttgtgagtccagagacgatggaagagtttggaaagttgtcagcttatctttgcatatatttgtccaatgataattaagcacaaattgtttcaaaaatctttcaaaaattgttataaagatttttattggtgctaagggctgtaatttagcaaagtcttacacctgaaaccaaccaaagggtcttagagtgtgaactgttgtcttagacccggagaagtctccaaagaatgaccatccgaggcattcagctggcgtaagaggagtgactcatttgttcttcttttttttttttttggctgtctacagagaaggaggatataggggcccttaagagaaaaactggagtagggtgtgtgtgtgtttgttttggtcaagggcagagtgtgctgtgtcagggtgtttcattgcattttcatatttgtcatttctctttggagcgtgtcttttggtgccacggaaaagggctggattttctatcgggtacaataggtacctgcagggcttagggtacaagagcttgtcggggacctgcacacatgtttgagacctgtaaaaatattgctggctctgaattatggaaagaaaatcgcaaagttaaaatctatcaaagtataattaaatacctacaaaacataatattatgtcactagtcaaccgcaacacaaatcttatatcattagatttcagtgatattgaatgtgggagatggaaccattttagtgcatttgatatgatgtgatgtggctttctccaagcctgagagtgcctgaaacccagagaggtcgtacgttgaccatgccacggggcccttcctggtaaatctaagcagaaatacaccatgcatgagacagaacaaagaaaagaactgtgaaaatacactcaggaccaggatgctgatacagtcatgaggttcagcttaaaaggccagtttctctactgcagaataatgaggtctatcctgttttgctttctttcaaagcccttaccatttatgaaaccagattgcaagtctgtttgaatcccccaaatgcctgtgctacataactgtctccttactctgtgctcttgccccaggcagagtggaagttgccttataaagctgcgacttggccacagtgttttccctttcagcagggaaaccggagttctccctgctgttgggaggttcaagagccactctgtgcagaaatgcccagaaagagttaagtgaggtaagttcgtcagacttctgcagacccatactgtggaagggtcaagtgcagggtcaccaacccgttccatcttcctgtcagttggcgtccacccttggtttcaaagggaacaggcattactgacatgacgggacctttacagttcccagctgctcatttggagtactgcggacccaggacaactaaagccggggtcgcctgccctccaggggttcctgggttgaagtatctgttccctccctttattttttctagcctttatagaaatgacaaagggtcaggtggtcttaaattccaaatctgggcacatgaatggtctgacctcggaaacttcctatatgctcgaaacgatttaactagcagcaataaaatctctactctttttatgacaaataatctagcatgtctggggagcatatttgattcttcatatttgggacccttttttaaaggctgagttttattaaaatgatagaaaaattagttattaaacagtatgtcaaatacctttctgtcccaccagatttatttttaaagacaaacattacagaggggcaggggaaggttatatttgaaatctttctatcctttctctaaaatatatttggtgaaaactaggaagtgttgatagatatcattgtttcctgacaggtttttggtgtttgcatcttgaaagtaaaactgccaagttatttttttgttctggtttttgttttttaagcttttctttgataacctcattttcaaggggaggcttagcactgatgtattttattttcttgctcagagaggaaacactgaaatagctatatgcttccccaccaggagagtggaagaatcttgcttttaaagcgatagtcctattttctaagtaaaagtccaggcatgtgacttaaaaaagaaaaaaaaaaatgttttctggtcaagtcacatgcctctgaggtttttttttttctttctttcttttctttttttttctttttcccagactcctcatacccctcctaggagacagtgattccctggcttcaccaggcaggctcttgggggcttcctggtccctgtcactcttaaaatgcagcctgtctttggacatctactccaagtttgcattctgccttgccttgtcagtctgggctatcaaaaatatagtttcgtttggaaaacaaaggggtgaggtgggtccaaagtacaggaagctataccatgcaaatgaaaatattttttccaaagctatctgctaatccctgtgatttaaaaatgtgcgtgtttttagtttctgtctaatttcaaccttttcttgctttagtgattaattaccaggtttctctattaagagcttgtgcgtgtgtagggggtagcatagaataaacaggctcagagcccccacccccacccccctttaagtaacagtgacgcaaacgacctttatttagcagaaggtagctctgcgaatccgctgaatgtccgattgcgatctcgctggaaagactgctgcttcagcaaggtttctttgctggtctgtggcaaggtccctgcttcattttcaaggtgtcctcacttggtgcctttgaagggtttttaatggattcgcttgatataccttccaaatggagtactttgtgcgttaattcagtttgtgataaagatcccttttaccctccttttcataattcttcccagagatatgaagtacactagaaggttagatgtggcatttaatttttccacaaaacctatccatagagggggaaaaaaagattcaatttcattactattcatgtgtaagaatattgaaggtggtatactaaaggagataactatttcttcttctatcaaaggaagaacaaatctgtctttgaacgaggagctcaattcttatttaaaagataaaaggtcacctacaatactcattcctttaaagctatagtgttggggtgggaaggaagctgtcttacctggacatattaattttaaattttgcttgaaaaaattgctcagtgcatttattgactagtctctctgtgtgagttctgaaagtctgtttatatctgttgccccttctcctaaagtgaacccagatatgtgggtatggggtgctagtttttatattaggtctgagatgtggaaaacagaaatctaacttagggatgtatcataatcaaaccgtcggggctaatggcatggctctgatattataaaatctggaggtttggaatgcagcaaactctgggggcattatcattattattattaatagtttgtatttacaaatgtggcattaagtagaacaacgtattcttgcaattaatgacaggaagcctacaatttctcattaagcacaggacagtgagaacgaacggaatttcagagacatgtttcttaacattaaaaacaacaaaaacaacaacaacaacaaaaaaccaagtaggaagcaggcagagttgcaatatgaagaacaatttcaatcatatgttgtttaattgagtttaacaagtaaatgtatatcccagtgtgtgtggtcaccaaagcataatgacaagttgttcatcatttaattagagatttgcttattgaaacgactgaaataggtagttgaaattttgcccttggacaagggagtaatttgtgatttgctacgttcatttcgtgagacttttggtgaaagacatctccttctcatatgtttaggcaagcgttgatgacatcaacctagccttttattttaaatcccctgtcaacgcaattagataatacaaaaataacaaaactacaggaggttgaggatggggctgggggccaaggagattacttggtttgaaatgaataaattgtctatcctaagggaattctttggtgcattttattgtgtgaaatgagcctggtcatatgactgccctgcctccctggaggcctccctgccctcctccttcccacagacacttatgggaggtactggccagctctgtatggccagtactgccctaagcaagaccaagaagcttagtctcaatttcagagagttattttggcaacatatttgggaaaatgatagttagatgctgcgttagccagcctctgcatgattttttacgcagaacaaacagttccaaatatcagtgctttcagcaactcatatatttctcacttatggtgcatgtcgctgatggttggctgctgctctgatctcactccagtatcagcttcagtcaaggaacgtattgttgtcaaggaaaggaaaaagaacagtggtgagaccaaaggatcttaaagtttctactttggaaggggcgtggcattgcttctctcattccattggctgaagcaaatcatgtatacaagccagaagccaatgagctataggaagggtagcaaagaacagaacagccatacagcctagcccacagatggggtcaagaagattcaataggcattggctgaagacttaagacttctcaagcaagttggatcctggtgtgcacctggcatatcctttaggattctttagtgttggtagattgagatggaaatgaggaaacttgtattacctactcctttgggccagaatttgcttacagcacagtgaggaggtattctttggagagcactgtttcccaagagtgattctaacaaagaggtgtaaatggacaagaatgaaaagcaattgcaagggcccttgaaggtttgtgaaggatggcaaagtgacttggatgttgatttctaaaggaggtaaaacttgaaggtagacaagctctttgtgtccatacatttgatgggtcatcctatgaaggagggcccatctcttacggcaggcagcgtggcgtaggcctcagagtcaggcatctggggcccagccttttctctgcaggtgcgggtggctcttggcacatgatgtaggtttttgtttttgttttgttttgtagacagagctcaatcttttgcctaggccatagtgcagtgtacaatcagatttcattgcagcctggaactcatgggctcaagcattcctcccacatcagcctgccaagtaggactacagttgtgcactaccacacctggctatttttaattttagtttctgtagagacagagacttgctgtgttgcccaggctggtctcaaactcctggcctctcaagccatcctccagcctcagcctcccaaagtgctgggattacaggcatgagccaccccacccagcccatgttaattttttcacctacaaaatgaaggctacaatatttactttgcaggattgctgtaaggattagaaccaccgtctctaaggcattcagcatagtcccttagggtaacatgagtgctcaagaaatagtaaattttagtatgtgtctcatttttttccagatgctctggggtcactaccaaccttgcctttcaccctacctgtggatctatgaccctgtccttctcagaacaccactcagtacttctgggttccccaagaggtgcctcttgagagtttgtaggaaactgtgctttagtaactcatggtttctgccctcagcttctcttgcatggggccttcctgcttgctcctctgctcacaatgacaagtgaggactcccctccatgccttttgatgctggtgcccatcaccccgatcacatgaacgtctatgcccaggtcccatttcctgacattcccaacatctctaccttctccgggcctagggcagggatcactctttcagaaacatgagcgtatggaagccccagtgtgttccttgaagtcccgatgcgtgatttgtccccatgctgtgtcgcacttggtcatctggaccctggggttgcctgagtgtccctgttacaaggcccctcctgaaaccagattggtgtctatgagggtcatctgggaaacctacctctggcagaatcgctgtcctgccagtttcctctcccccttacaagggacatttatgctttctccctctacaaaacctgcatgcaaattatctgatggaattgacccatagtgggtgttctccactggttcaacacacctgaattccggattcaagatgcaatcaccactactgttgttgtgtaagtattgctagagatggctgcagaatacctgggaaagctagctaagcagtgactggaggaaggccccagctctttggaacgaactttccagccgagaatgctttccaaaatgggaacaagatcccaaccccttatcagaaactttgggggccggatgtgtttcagaattcagaagttttcaaattttaagaagagaatacactgcgtattctgtgtattacaggggtcagcaaattcacagcccataggccaaatctggcctgtttttgtaaataaagttttattgctatacagctgtacctgttggtttacgtactgcgatggctgctttcagctacgttggcagagctcagtagtcatgacagtaaccatatgcccacaaagcctaaaatatttactatctggctctttgcagaaaatgcgctgaaccttgcatgttgtgtcacccctggaggtagcaccttgtaattaagcacatgaatatctcacatcagaatgaatgaatattcacactcagtgggacaaacaacttctgtcagctgtagactgcttttgccatcaaatggttattgaaagaactatctgtgttgacagccttttgggtttcatacagtcctttccagcttgggcagtatagataaatagatgcacaaagcagagggaatcaagtagaataacatggtttatttgtgtgtgtattgttctgtttttggtaaaatcatgcttatcatatcttcaatgcatcatttattctgagtccacattgctgcctttgagccggggccctgaggtatctcctatactctggctggggtgagggcggcaggtcctctgggccagcccagatccaccctgttcacggtgtgtgtcctgctgggctcacttctgaagctgaccttggggagcagattgaacacctgttgatgccattctcttaatttcaggggaatgtgtgggtctttgagctagagagacataggtgtatggcagatgagggaccaccccctccaccttagtccagttacagggcctcgcctttttgatactaacgctacatgaagagggacggggccaacagcaggctcttccttgacgtgttttatgtacactccagaaatattgacagagttgtctttttgttttggtttttaaatgtttttttaagttaacttctggaatgcatgtgcagaacgtgcaggcttgttacataggtatacatgtgccatggtggtttgctgcagccatcaagccatcttttaaatccattcttagattttccttttccatagctctttgtgatgcttgctttaatcagttgatacatgtttaatcacgttttgctctgggctgtgttatatacagctccctccctaatcttgctagaaggtagggctaatgcattgtcaattcagaaatagggggtgttcctgagtctggggacactctagtgaaattctatgtgtaaaataatttgtacaagtttatatttttagctaaattaaaatactcacattcccattattttttagaggttgtaagctaagtaataacattctagaaactctctgttttttgaaagggcatcaccactgttgaaggcgctaatgggagatcctaagtttcaggctctgctacagacgtcaggtcccctaggagttgggctgcctttgctctcctctccgcgactcggtacctggtgtatagttggctaaaaagaagttgttggggctgggtgcagcacctcacacctgtaatttcaacacgtagggaggctgaggcaggaggatctcctgaagcccagaattcaagaccaggctgggcagcatagcacgacccatctctactataaatttaaaaattaactgggtgtggtggtgcacatctctagtctcagctgcttgggactactagaaaggtaaggcaagagaatcccctgagcccaggagttggaggttgctgcagctatgttcgcaccactgtattccagtctgggcaacagagcaagaccccatttccaaaaaataaatgaaataaataaatacataataaataaacagtagtggttgaaagaaagggaaggaagaaatgctgttttaggaaatcaataggataatttttttttttttttgaggcggagtctcactctgttgcccaggctggagtgcagtggcacagtctccgctcactgtaagctccgcctcccgagttcacgccattctcctgcctcagcctcccgagtagttgggactacaggcgcccgccaccacactcagctaattttttgtatttttagtagagacagggtttcactgtgttagccaggatggtctcgatctcctgacctcgtgatctgcctgccttggcctcccaaagtgctgggattacaggcgtgaactactgtgcctggccaggataatctttaagaagaagataacattagctattcttctcacttcctacgtagaattccctaccctgtgtctttggcctggaaagggtattggtagcaattgtcttcggctttccctgccatgtgtatgcattcccacggccacacaagcacacacacacttttgtggttttttttttaattatataagcaagtaggatgtttgtcttagtttttttgggctgctataacaaaatgccatggactgaataatatataaacaacggaaatgtatttctcacaattccggaggctgagaagtccaagaggaaggcactggcagattcagtgtccggtgaggatttgtttttgatctcataggtgtccatcttgctattttctcaactagcagaggcaactctctggggtatcttttaaaagggcactaatggccaggagtggtggctcacacctgtaatcccagcactttgggaggccgaggcaggtgtctcggtggatcacttgaggtcaggaggtcgagaccagcctggctgacatggtgaaaccctgtctctactaaaactaaaaacttagccaggctcggtggcttgtgcttgtaatcccagccacttggaagggtgaggcagaattgcttgaacctgggaggcagtggttgcagtgagctgagatggtgccactgcactcctgtctgggagacagagggaggagactccatcaacactaataataataaagtaaataaaagggcactaaccctactcaggaagccttcactctaatgacataattacctcccaaagtccgcacttcctaatgttaccactctggaggttagaatttcaacatataaattttggggggacacattcagaccacaataatgttttataatgttccttttgctttaacaagagacacatgtcagatagtagacatgatctgagaagacacaaaacccagcgtggtgattttggcagccttgccatgcatctctaacatgcacatggccagaaaaatagcttggacattctgttcaaccctccacatcaactggtcagtttagtctttaaaaggtgataggcctgttgtggtggctcacgcctgtaatcccagcactttgggaggctgaggcaggtggatcacttgagccccggagttgaagaccagcctgggcaacacggtgaaactaagaatagaaaatattaggtgggcgtggtggcgtgcacctgtggcctcagctacttaggaggctgaggtggaaggatcacttgagcccaggaggcagaggttgcagtgagccgacattgcaccactgcaccccagcctgggccacacagagaaaccttgtatccaaaaaaaaaaaaaaaaaagtgaccacactgtggctttgctgctttgcctaagtatttcgtgaaattgatcgttcattcacaatgctcagtgcagtgactttgccgagcacaagtggtggacttaagaagccacataaagaagcacccacgtctttctctgaggacgtgcttgtgtgtgttctgaggaaagcaggtgatgatccctgaggtgtatcccccaatcccaaactagaagtgagtccccctgctcctcaagcttgcatggcgctcaggtattccagtgggccccgctgcattcttcccagtcccaggaaatctttgtgcatggctgtcttttctgtgccatcttgggcatctcacgcattggccctatccacatgttgcctccagcatcccaggaactccgttaatgtttatttgaatgatggaatgaaggtgtcttgctatattttgacatttctgtcaaaatatgaatctatctttgcctagcatcttttcatgtgcacattgcccatctttataacaaagtgtgagtgggaaaggacttttaatcttcattatattatcattcatatgaataatgttaacaattagtgtttattgagcacctgctatgagccagatgtagtgttcagtgctattcatgtgttcttgaattaaattttcatggcaagcctaagaggccatgactgtccacattttgcctctgagagacgcaaggcttggaggcaggaaatcactcactgaaggccacagcacaaagtggggacttgagtcccgatctcactgattctaaagtccttgctctccaacctctgtccatctgaaatggaaaagcactgacgcagttctcactctggagcttgttttattttgcttgggctgctgtagaaataccacaggtcaggtggcttaaacaacaggaatgtagttcctcacagttctggaggttgggagtcctagatcaaggtgtcagcagggttggtttctctctgtaccattgtccctggcttggagatgaccatcttctctgtcttcacatggtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgctctcataagagacctcttctcaacaggatccatgtttgatccgggggaataaagctagagttgctttcttccttgtaatatgtataatgactcatgagagaattccccactgtcttccccacctgagacctgagaggaggagaaggaagcttggagtcgctgccctgtggcctgaattggtcagtgaccaatcactcagacccagctgacaggctatacgcggacaccttggatgtgcccagcatggatcttctccaagtaggaggccttggagtcagagaaaggtgcaactcccactgctgctgcaagaacaaagactttaagatactgaaatttctgggcaaagtttcctcaactcttcatttaagtgttaggccaggtggggtggctcatgtctgtaattccagcactttgggaggctgaggtgggaggatcactggaggtcgggaatttgaaaccagcctggccaacgtggcaaaaccccatttctactaaaaaaaaaatatatatatatatatatatatatatatatatatatatatatatatatatatatatatatatatatatatatgtagccatgcatgggggcctgcccttgtagtcccagctacttgggaggctgagacatgagaatcgcttgaacctgggagtcggaggttgcagtaagctgagatcgccactgcactccagcctgggcaacagagcaagacgccatctcaaaaaaaaaaaaaaaaagtgtaatgcaagtagaaaagggcacacactccaggtgtatatctcaacaaatttgtacacactgcatgcacatgggtgacccgcacccacatgttatacacagaataattacaggaccctgccaacctcctcctatcccctttcagctcctgctgtgatgccacttctaatctcaattttattatacaatttgttaaatacagaagtaaatggaggcaatagtgatagtaaaaagaaccatgtgaattgggcgtggtggctcatgtctgtaaagccagcacttcgggagtccaaggtaggagggtcacttgagcccagcaattggagaccagcctgggcaacatcatgagaccccatctgtatccaaataaaagcaacaaaaaaatgagacatgggggtgcatgtctgtggtcccagctactcaggaggctgaggcaggagaatcacttgagcaaaggaggttgaaccatgattgcaccgttgtactccatctagcctgggcgacagagtgagaacctgtctccaaaataaataaataaataaataaaaataaaagtaacagaaccataggccttatctttatctgagttcctgtagcatgtgcactactcctgattaaccaagtgaaagagaaaatgagactaatctctaacgtcagcttccttttctgccaaatggaagatcatctctaattaataatgagttagaatacctaggacagtatttggcacacagttgatgaggatggtgtacctagtagctaatggtgagtaggatgaataataatactataccttttggtttctgaaatgagaaatctaaggaactggcttaaccaagaagcagcaagctgttttaattgtgctgttaggagggctgtttgttaaggtacagaagaggattggcccatggctttctgctaagaacctgctgaatgtctgtatagaatccctgcattgtgcctcctatcaatcaggtgcttaggtttgacaagtttcctccaacagactcgtgtagaagtttctgtatcaactggaaaaaaccatggtgcttgggacattcaaggccgaaacttggtccctggatgggagaagatagctgtatcattggcagagctgccttggtcatgtaccctctccagactagacactagatagtgggtagggtgggacagttttatgtcctctgccaccttatctgggactcttgtcccctgagaagtttgaaaatttggcacattttagtatttgtcagtgtacttcctgcttcttgatgcacttgtactgcacaagaattgattttcaggaaatatggtttttttttcctttttgcacagcgatgggttagcaaaatgcatatttgcatagaaataatctttagtgagctctgctggcaagtgtgtcaaatttataaatatcactactataaagacatacttttggatatggatttcttcctcagtttatttcttctttcattttttcatgtccaggtcactacgtattgcgtatatttggttggaattttatttttgagcaattcacttacccagattgtgtttctggagattaaagcatctcactgtatttttagttttttctacattgcaatttcaaaataatccaactcaaaggctgttgaaaggctccttctgtttaaggtaaagcctgtggcagcctttaacttcctttctcttctcctgctgccaccttggtccacagtttatctttgaaaatgctgggttttaatgggcagggtatagtgcagaaaccagatggttttaactcacacctgtgaaaatgctggggatctgcgaaacattaaagttaatggccagaataaggctgccaagctcggtggaattgtacttaactggcatatcattctggttaactgaactttccattaactcacagatctatcttttcatgcccccttctaaccccctactcaccacccacccagttcctcctagtgggcagtttgctgctgctgtcttacctcctcatcctcacccctttcacctctcccctggtaactgatttatttttccctcttggagttgcttattcttttcttcttccagttgcatctctccctctacttagatacacatttccattttacttctatttggtagtctcagaacttggcttttattggccagtatattcaatgattcacttgcacctttaaccttgtgttgttctaatcttttttttttttttttttttttttttttttgagacagagtcttgctctgttgtctaggctggagtgcagtggcaccatctcggctcaccacgagctctgcgtcgtgggttcatgccattctcctgcctcagcctgcggagtagctgggactacaggcactcaccaccatgcctggctaattttttgtattttttagtaaagatggggtttcaccatgttagccaggatggtctcgatctcctgacctcatgatctgcctaccttagcctcccaaagtgctgggattacaggcgtgagccaccgtgcccagccttcttgttttaatcttttagacaactggacacaggtttgtctttgaaattgtactggtttttcttgatgttttagtgctcctggatgtccaatgtcattcttgggctagttgaaggaaagttttggctacccagttgttagctgctgaagtttaactgtgcattctaagcacaccagtattttattacatcatacctgggcagcagataattttagtaaaaccttgaaaagatatgactattgggaagaaatttgggattctatcctttttctctccattcttctctcctgcaccaagtttctaagctcgtgattaaataaattctgaccctactctgataaaagtgaacccttgtggctggtcgcagtggctcatgcttgtaatcccagcactttgggacgccgaggcaggcagatcacctgaggtcaggagtttgagaccagcctggccaacatggtaaaaccccacctctactaaaaatacaaaattagtcaggcgtggtagtgtacacccataatcccaggtacacaggaggctgagacttaagaatcgcttgaacccaggagacgggggttgcagggagctgagatcgtgccactgtactccagcctgggtgacaagagtgaaactccatcttaaaaaaaaaaaaaagtgaacccttgtagtttcttcctctgtttgacagatggaccctaagacggccccagtgataccccacctcctggtgtccaaggcctgatgtgatcacccttcccccaccttgaatgtaggtgggatatgggagacttacttctgaccaatagaatatgaaaaagataataggatgtaactgtttagattcggttacactatatggcaaagcaaagggattttggaaataccattaaggtcttacatgagacagattttgagttaatgagcagggggatcctcctgggtgggcctgacttagtaaggggaaaatcccttaaagaggagctaaaataagagagtctctctctccattgctggctttgaaaaagtaagctgccttgcagtaaggaactgcatttggcttctaggagctgagagtgccctaaggaagccagcaagaaaatgaggacattagtcctataaccacaaggaaatgagttctgctagcaacctaagggagcttgaaggtgattgaccatccccagtcaagcctctgatgagaccgcagccccactaggcaactagatttcagcatggtaagaccctggatggagaacccagctcagccatgcccagactcctatcctatggaagctttaagataataaatgtatgtggctttaagctgttaagcttttggtaatttgttagatggcaacagaaaatgtgtacaccctggatagtagacagagactgcatctttctttggcatttggctgcacagcaagttctaagttactcaccaggtttcagaggagagatgggaatttgatgatcttataagaaacctgtactctttggccagacacggtggctcatgcctgtcattccagcactttgggagaccaaggcgggcagatcacctgaggtcatgagttcgagaccagcctgggcaacatgctgaaaccccatctctactaaaaatacaaaaatcagccaggcatggtggcgcatgcttgtagtcccagcgacttgagaggctgagggatgagaatcacttgaacccgagaggcaggggttgcagtgagtgcggtggcagctgggacattaaccaagttgtgaaaggagccatgatgttattagctgagtcatgtcactgcacctccagcctgggcaacagagtcagactctgtctcaaaaaaaaaaaaaaaaagtgtactttttgaggaaagttctatttttcattattttccactatgaatgaagaagaaaataatatacatacattactgggattcatacggacattatttagacacacttccacctacagagtcacatattgtatagaataaaatatcatcaggagcagctcatgtgaccagaatgtggcaaagtctttgctctacaggtcaagttgggacttactgaggagaaatgaggggacttcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaatcatgttcccttcggaaaactccctgggtgccccagcattatgtggtaaaggacatgtatttccaactggcaggggctctgcaaagtttctctgcctcctttgctaaccaaaccctaaataattgtctggatgttccttttattgtcacctctgaaacaagacgaagatttggacggtttgctttagagtgcattaacttctttatcacattaatactgactcatatcttatttcccacttgcaataagaaaaccattcaaatctttccctcacaggacaatatctttaatagcttctgtgtgtttcctatttttggctgtttctgtataaacagactaatctaatagcatactgaacccatctaacttggcagaaattcagaaaatcactcatttctatggcaagctgagatgctgagaagggggaaaaaaccctcacttttattgcagcaagatttttctcaaagttgcctttcatgaacataatatgtctatcatttggaattctccagcaccctggctggaaattatttattgcagaacgacacaatggtgaacgagaaggtattattccctgtacgatttctggcttgaatttgtttgcctaaaggagcagatatcgtatgaacatgattttgaatgctggcatggtgatgaaaggtgatgttcacctggagtctgtacacacaaaaccctgttcattttacctaaagggtaagaacatcatggcccccttcatatcctggttaatgtccccgctgaccctgagttctgcctccatcactggaacaagagcctgtctttgggaagaggtgtcttccctggcactcgtttgatttgtagccgccacacatggcaggtcccaagctgtctgaagtcttggctgccattcctaagctactaaaactttgctggagaacatcaccaatcacgctgagggatcctttgacaactcagcttcatgaggacagctgcagttctgcgtttaggctggggtcaccggggtcgctgccccagccccactctttagcctcagtccctctgtggttcccctgactgagctcctcactaaaggggaggaatccctggagcctccccatccaaggccagcgtgttccatttgagggtaactggatccctgaaattcacccccacacaatccacaacctactactagaatgccatatgcttttctatatgctgttgtttaatttcagttggtacatattttattttttgaaacagacttcgttagaacatctttagatttaaagaaaaatcaagactgtagtaccaagttcccatgtgtgtaacagccagtttatcctattattttaacgtcttatgttatttggtacatttattaagattaaattattgatactgaaatattaggttgtgcaaaagcaattgtggtttttgccattaaaagtaatagtaataataatactcggttggtgcaaaagtaaatgtgttttttgctattaaaagtaatgcggttttacttctgcagtttttttgccatttgccaattacttttgcagtttttgccagtacttaaaagtaatggcaaaaactgcaaaagtaattggcaaatggcaattgcggtttttgccgttacttaaaattgcattacttaaaagtttttaagtaatgcaattacttaaaacttaagtttttaagtaagtttaagtaaaatttgcattacttaaaagtaatcgcagtttttgccattacttaaaagtaatggcaccaacctaatattgttattactttttaccaacctaatattgttattaactaaagtccatcgtttatcatattgccttaggtttttaaaaaattttttacctaatgacttttttgtgttccaggagcccatccaggataccacttttatttattttttttttctttttgagatggagtctggctcttttgcccaggatggagtgcagtggcgcgatcttggctcactgcaacctccgcctcgcaggtttaagtgattctcctgcctcagcctcctgagcaggtgggaccacaggcatgcgccaccacgctcagctaatttttgcaggataccacattttatttaattgtcaggtctccttagcatcttcttggctgtgacagtttctcagaattgtctttgtgatgaccttgacagctttgaggagtgctggttgggtattctgtaggatgctcctgtgttgggatttttatgatgtttttctcatgagtttactggagttaatgaatttcagggaggaagaccccagaggtctgttttcatcacatcgtatcaagcattccaccttcatcatgactcttcactgttgatggtgactctgattcacctggtcaaggtagtgttcattaggtttctccactgcacacttagtctttccctctactttccacactgctgcctttggaggagtgttgctgtgcccagctcatgcttgtggagtggggatttaatgttctcactcttcgagggtagagtatctgcataaactacttggaattctgcatggaatatttgtgtcttctcccccatttatttatttaatcatttatttatatcacggtacactcatggacatttattttatgctttatgttataatcctatactactttatttattttgttgcttaaatttttccagatggaacaatttggtcttcaaaagttgctgctgttggctcctgtgttcttgtgatgtacacacatcatggtgtggtgtgtttttatctttggttttgttttcacttcttttttgctttttgtgcctcctcttccctcttccccccacctcatacatacacaaagggcagcatgctactataatttctggaatctcagccatattcttcttttttttgttttaaataaaaatcatactagagcagtaggcagtgtgggtgagttctcccactttacattttactttgcataatttaggcccctttcaggccactcttccccctgtgccccaggtgtgtttgctaccatacctccccaggggatagccctccaaacctgattggccaactagtctggtcttaaagtcccaaagggaggccatcacaaactactcagtatggagaagacctgaatcctaattttggcttaaccccaaacttgggcgattcagttttacctgtgtcctctctataccatagtttatgacaaggggttttctgtggctggtctccaaggcctcttccaatcttgacattctgtgatcctgtaagtctttgaataatggcccaggatgccaacaagaagtcaccaatgagagttcaggtgttctgttggaaatctttgtaaaatcacagagaaaaggagaagaaaaagaataaagaggaaaaactggacacataaataggaagacaaagaatgaatgtggactggggagagaagagtcattgacagggacaagaaataaataactttgatgcaaatcctgggaagactctggaacaacatggaggcacctatgttaactctatttcattttggaaaagttgactagacaaaaggtgcagagtagagtatgcagtgatttcagggtgttgggctctgacaagatgatgccgacttagacagtgttagtcaacatcaaatgtctggatcaagagaggcaagaatcccgtggatttggcgttggccagaacttgtctggaatcttgttttctgccttgagtgtcacctgttgagagctctgttgacaaactggcatttgtccttgggagagtagcctcaggaccaggggtgaagagttcagtaaactgtgtttaacccaaggaaagatacagggtgtgtcagattttgtaaggattttcaaggagcagtagatagtggccctacagtggaatgaaccttcacaccgaggatctgcttcctttgttggaggtgggaaagcaaaagctggatgcttggaattgtcatggctgccgtctgagtgatgctaccttgagtggacggtttggccaactaaggagtaaggcctctccctcatgtcacattgagtggtgctaatgtttcctgaagtttccctttcttttcagttcagtgtttcagaatctcagccttccagcagaatcccctttgtttgctctaaatatacattcccaagccccgtgtggccattctgatttactaggtctggggttgggggattgtgggtgccgagaatcagtatttctatcaagctcccaaggggacctgatatatacatggagctgaaaagtacccacctaacagacttgccagctccttaaggataagaactatattttcttcctttttttgtatgcctccccatgcaaggataattacacagaataagcactgagatgcctgttgatggatttattccagcaattttttttttttagctctctttgtctggaactttgcaaaataaacaccatggtcactccgtgctttgtgagtgacgtgctagaatggaatttcactgttttaaattcagggttaatttcttgctttcaaatgaattatgaaaggaagaggagagacctttggaaaagtctgaatgttgatgccgacgactagccaggcgcttcccttccagctggtttcgtgagggattaagaggccactgttgtgaatctcccattagtgatggtcccaggccccctcctcattgtgcatttatcttacaagaggcatatttaggagatgtttccgttctattttatctgcagaattactttccattctcaggtcttttatataagtattcccttgaacccgttccaaaaactggatttttaacccaatagaccataactgcagtgttttattgtgcttacatatttcaaaatgtgaatgtaagtagatttagcaaagttaaaataaaatgaaaacttttcaaagggcaccactgctcgcattcccatgttggagttttccctttggggttcttatgccattttaaagactctgaaaacaggaagactttttctcttgggtattttatttttttttcctctgcaagggatggggtcataagacattggtgaggttaggccttcctttgtctcccaggagcacacttgatagcaatgtagggtgaattccaaatctgtgagttagtgccgtatatagcagtgttgtcagtaagatttctcactggcatctctgcttcccctcttgactctcttgaaatcccttcttcaggcagaagctggagtcatttctctaaaatagaaatctgatcttgccaccaccctacttgccactccctgcttaatcccttcactggctcaccatatcccttaggataaaataacaaaatcctttccagggcctgcaagacccctgccaacctctgcagcttactttgtaccactttccccagaaacctgctacctaccctgctccttgccacagggcctttgcacaggctcttgtctctggctagagtagtcttcccatcctgctttagctaatcaactctttctcatcatttaggcttcaaatggatcatcactttctctggggtgcaggggtctttcatataagtatttctttgaactcattccaaaaaagtggatttttagaaatagaaaaaactaatttagaaatagaaaattaattgagttttagtttttagaaaattatctaagaagtagatttttagaaatagaaaattaacgtagatcacagaaaattatccaaactcagttaattttcccttttccagcaactgtatttgtcctccccacttctcttccctgccttctttttttctccttagcacttacaatgtctcactcatgtagactcgaagcttcacaagggcagggattttagtctatttcattgaaaatctgtcaccagtcactggcccagagagagtcctcaaaaataattgttgaatgaatgaatgaatgaatgaatgatgatggcgtgatgattgtgtattcctcatctggctgtaagtttcacaaggccaggcactggggtcctattttgctcactgttgctgtgtgggaaagagttagtacagcagactgtcgcaagcttggctcttggctgcatctgggaacttggaatttaggagggctgtcaccattcccagatcagataaagatggctcactctgtctagactgcttgtaccaaaaatagggctcatgtggaatacctgctttcctttgtggaggctggaattttgttatatgctacagagagggtgcctacgtggccaacttccaataaaaactgtggacactgagtccctaatacatttctctggtagacaatacttcatatatattttcacagctcatttctgggggactaattaaatgcatcctgtgtgaccccactggaagaggacatttggaatcttgtacctggttttctccagacttcgcctcattcaccatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactgggtgaatgaacgaaagaggccatatgcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcatcacatacattatatgcaaatactatacaattttatgttagggacttgagcatttgtggattttggtatttgggggggttccttgaaccagtcccctttggatactgagggacaactgtacaaatcacatttaggagtggatgcaggtcagtcgtgacatctcatccaccccttcctcacccaagattctccgtggcttgtgtcaaggcctcaccacatcagaatatttctgctcatggttgctgagacagagctggacaggtccagcatccattccccaaaacagaactcaaactgacgatcatcaagatattccagctatggcaaactgcggaagaattaggacagatgtatgacttatttcatataaagctaaatcagtttaatttatatgattgtcctttattatgagattatgttcaacagatattttcagtgttaaaatattcttttttttttttttttgagacagggtctggctctgtcacccagggtctagcacagtggcacgattttggctcactgcagcttcctcctcccaggctcaagagatattcttgcctcagccctccaagtagggctacacgtgtgtgccaccgtgcctggctattttttgtagggacagggtttcaacatgttgccaaggctagtctctaactcctgggctcaagcaatctgctcacctgggtctcccaaagtgttgggattataggtgtgaaccaccatacccagccaaaatattcttttcaaagtgattagaagtaggagaagcttgctctctttttattggcacttctgtcttacatgcactttttgatttaaattattctgtcttctatgaaatgacagtgattggaggtggtttatttttttttaagtctgcttactcggaaaaataaaacaaagttgacaacctgatttcagacctcccaattttttcttaaaaaaaataaaagtcttcttggtccatgaaatccagaaactggagaccaaactagcaaattcgcaaggagctgcttgatagaaaaacacttgagatcaagagtcagaaatagctgggttgaattccagttctctcatattaagtgacaagttgcagaatgcccctgtctttctgagctgtttttatatctgtacaatggggttaatactactagtatttgcttccagggattgttttggaggggagtgaggaataaatgatataattcactaaaacacgtagaatagtatttgacacagagtaggtcagcatgcccaaagtatcagagtcattattgagttattccgctacctccgtatttgagtcctttcttttgggctttcctacttaacgtcgcagatgttatttttttgaagagggtgtaggccaagaaaggggtgggagaaacgagcaaggtgttgatagaaccccttagtgtcctcctcataccacagacactctcttcccccacttacttggccaatttttttttttttttttttttggtggagtctcgttctgtctcccaggctggagtgcaatggtgcgatctcagctccctgcaacctctgcctcccatattcaagggattctcctgcctcagcctctcgaatagctgggattacaggtgtgcgccaccacgcccagctgattttgtatttttagtagagttgggatttctccatgttggtcagactggtctcgaactcctgacctcaggtgatccacccgcctcagcctcccacagtgctggggttgcagctgtgagccactgcgcccggcctacttggccaaattcttgcctgatcgcctctccacccctgctacgtgtaatagaaaggtagggccatgttggagagggatccaacatttattatccccattttacagatgaagaagttaaggtggccaggcatggtggctcatgcctgtaatcctagcactttgggacactgaggtgggtggatcacttgaggtcaggagtttgagagcaatctggccaacatggtgaaaccctgtctctactacaaataaaaaattagccgggtgtggtggcgtgtgcctgtaatcccagttactcgggaggctgaggcaggagaatcgcttgagcctgggaggcagaggttgcagtgagctgagatcgtgccactgcgctccatgctaggtgacagagcaagattccatctcaaaacaaaacaaaacaaaaaaacaagaagttaaggattgcagagcataagtatcttctatggggctacccaactaggtcgggacagggcagggatttgaacctaggagctcttggattgcaatttttcattcacccctccctctccacccttcctgtcttcaagcctgagcaggtgatactgcattttgtaccgtatgactttaaaacagaaccacgagttcagaactttggttaggtcctgcccgtgttctctagctaacgcatggcaacgctggtttccaacctttcactgtgcgggtttctgatgagtacgctggcaggcctctggcttcagagatgccactacaaaggtctcctccttttcataaacattgctgcaaggcccgcttctcaagaaagcaacttgtgctacctcctgcgtgcttttatgcttcgctgtgaagtgcaaagttgggctggcaggcctggctttcttctccgacttatgtatgattcatcaagaggactccaggctgtggtgtgcggtgcaacccgggctgtgttcccgagtgcatcaaacggggattgggacctgttttccttcccactcacatgtaggtcacctacgggagcaggggaggaaccatctgaggtgtttttttttttttttttagatttctcattgctgagaacagttccagctctgccgaccaaaggctgagtgtccttttattagtctgagcccctagagagaccaaagaggcaaccctcgagccaactgacagccagctgtggggttggaccctgtttttcatacagtgagcactcttgaacccagagaaggtgcaggttggagatgcagctatatgactctgtaccagagagagacctttttgtacatttggaataaaaatttttagcattagagattcgcttttttgtgtctaaatacaaatgtccaggagaataggaatgccatagtggtgagctaagagcaggcagttagttaagtgtatgacaagtatctcattataaatggatgctgaaatgtccaagtgtggaaatgatacgcttcagctcttatttttaagtcatccttatctctttcacttattccctcattcaggcaccaaaaatgctgtttgactgggagagcaagtggagctgttcaaagttgtagggacagccgggcgcagtggctcatgcctgtaatcccagcactttgggagggcgaggcgggcagatcacaaggtcaggagttcgagaccagcctggccaacatggtgaaaccccgtctctactaaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttaaaaaaaaaaaaaaaaaaagttctaaatcagtggattctgccgataaacatcatctggacggaatgaagctgagggccaatagtttagaggctcagcacccgactggagagagagagagagagagagagagagtgtgtgtgtgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaactgtacctcttgccactcaacatctgcagtcaaaggcttcctgactcaggatttgctggggtctggctctgggctattagaattagatgcgtgagaccctttcaatctaaaccttaagtattttgcctgttggacagatgcctggttgtccctttaatccatcgcccaaaaagcctgaggaaggatggcaggtggacttggatctaggccactcccttagatcctgattaggggacctctgcgactgctcatctgggaggaactaggggagcgctaatgtgttgtccttgactgggcaagaagggaaggagaattgtgaaacatgcacaattagaagtcgtgcacctgggttcatatcctggctgggccacttactttctggcgggtggggagggcagacaagttgctcatcctctctgcgcctcagtttcttcatctacaaaatgaagatgttggttatttctttattcaagggttgttgagaggatgaagtgctaaaaatgcttgaccagcattcacacaggcactaagacggtgagtactcactacttagcgctgtcaacatcatctccgtccacatcaatgtcgtcatcgtccttatgaaaagccctgggcatcattttgcccttgagctggatgtccatgttggaaaaacagctagtggaaggcgtgcccaaatctcagaagttggcgtttccttgcagatatcattggtggccattggaggggaaaaagatgctttggaaaccaggacacagagaaaagtgcctcgtattatacagagccaagagaggtcactgtggaagtacagaggaagccttggcctaattgcacggttaatacaattccgtaactcatcctgccaacacgaaggtagatggacggtccttatgctcgctgcggaacactgcctgtgttttcctaggagagacatctgcactctagtagtgattaaaatgcctttgacaggctcttgctattaagagtttctggctccagtttaataaaaggtagtatattataatggaaaccaggttattattgataaggactagacatattagagaccaggttaaagctttgatagtcccaaatgcaaggggagggagctaagggttattgcaaacctactgtgtgtcaattgctctaccagacacctcagagacatcacagccaaagacccccacctttgaataaaccaagtttggcctctctgatatattaatatatttaatcatcagactttcagtgttaaaggagattacagtagaggcatccagttgattggggaatagttgttgcaaatgataagctcttttgaataaactgatactgacttaatgaggttctgctgtgtactatcttttttttcctaatagaaaatagagtagctgccctccccatccgccattctcagtccttttgcttactagtaatgaccctcttttctctcactccatgggaacttttaaaactgataattaatggatttttagcctcaagtttctggaattctaagagggcctgaaaggtaagtgctcacttactgaggtgtgtgaacaaaaacaggcaacctagctcagcaagtaagaatggagtggcatctccccacctgctctggagtcatgtgtttgcttctggaagggaggcaagaggcattcaacctcctgttaatttggttgctccttcagatacgctcttcatggtacagccctgagctgcatcatttaaagaccaattgttaaggaccaatctgagggcctgtgcattagttaaaactccttatctggtcatagagggtggtgtggtttggacgcgttccccttgtctgtgcaattcccaacagaggcaagtgcgcatttgagacaggttgagggttcaagctgtccaatccctgctcatctgcagcacaccaaggaatgtggactaatgaaaaataaactgcatgcatgcaatgcccatcacactgcctgcattttctaatcttcacaataactctgtgttgagaaatattcctgtctgtaatcccggcactttgggaggctgaagcgggcagatcacctgaggtcaggagtttgagaccagcctgggcaacatggtgaactccccccaaccaacgacccttcccatatctactaaaaatacaaaaattagctgggcatggtggtggggacctataatcccagctacttggaggctgatgcagcagagtctgttgaacccaggaggcagaggttgcagtgagccaagacagtgccactgtgttccagcctgggcaacaagagtgaaactctgtctcaaaaaaaaaaaaaaattgtttctggccccacgttacagatgaggcttttaaagatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagcgcggagtaggtgcttaagcccttccatttgaaaggagctttaaacacctttggtggcagctaagagtgtcaaaatggagggatgtgtaggggacctagggcctgggtaacattgtcccaggccagggcctattgtgttgtgtgtgtctccactttccagcctttgggaacgcagagggggacctctgtaattggtaccagcatcccttccttgcagggtccgtccttcctctgagttgggggaaggggtctccatggtttcttctaccaggtagacccagaatcactttcaacttgctcacctgtctgtgcagtgtttgagttcttccctgggaagcttgctcacatcatccacttctctctgggttctccgtaccgctttccccaatccaagctaagctcttctcttagttattctaataactgcccaatatcaggcactaccctcaacactgtttcccatggcaattattttacatgacagtttaaaaaacaggaatgctcgatttgtattcccattttgcagacaagccaacgaaggcttggaggggttgaatggcccaagtttcctaagtggccaggggcagagtcaggatctgaacccaagacataggcccaggagtctgtgtttgttctttaaacctctctattcagttgcccagctcttttcattccctgtcctttccccctctggctgggtctgcctttccaaccgctaccaccttccaccaccattttttttttgtttcctctgcaagcaacatctgaaaggcccagacccagcttgttggccttgggctctgataagatctgtctgcactccttttgtctggcctgtacctgccttttctgaatgaccctgttaattgcaattgactctcatagaatgtggatagcagtgccacttgacaccagactaatgcttctgacttttccatggtgccccagcagcaggctggagggaagggcgggggcggtcagaggagagatagagcacttcagattccaatcgaatacattagagcattagagcttttctcttcctcagggtgctctctctctctgggttgggaggagatgtggcatttctaggaattcacagtaaaatcagaaataattaggagatttcacagttgtagctcctgtgaagattcaggaattttttttttcttctatttgcaagctttagtcctaggcatggaaaaagaactttgaagaaaacctgagagatatcagtgtaaaacaagagaatgattccctctggggtgctggtagtgggggcttaatttcctaaaggcttactgggtatcagggctgctttcctttataatcttttacccgtcttatgggggatgaacagaaacacactttagtgctagaaaagctgggcctaaaagaccagtctcctgtcccatacttggacatttattgttctttttgggcaaggtgaaaacttgaaaccaaaagtctgttgagtttggaagacttgactcccaggatgtacaaagtacttctgcatgtgcgcaaagtcctgtaggcccaggcatcaatgacacatgcagtgtgggcccaggcatcgatgacacacgcagggaagcaacccaagctgggtcagtccttacaaggagaccggcacctgggctcacaccttgccgtatatgacttcatgggaacctcataacagacctgtgggctcagaattattctctcactttgcagatgaggaaatggaagtgcacagaaggaaagtaagagtgtttgagatcctgtagtgggttcattgctgagaataaacccggagttgcctctgggaggacctggtggtgggtgggatggagagagaggcctcccctcagactccaggggcacagattggattttttttttttccagacagtttcactcttgttgcacaggctggggtgcaatggtatgatcttggctcactgcaacctctgcctcccaggttcgagtgattttcctgcctcagcctctggagtagctgggattacaggtgcccgccaccacgcccagctaattttttgtcttttttagtagagacagggtttcaccatgttggccaggctggtcttgaactcctgacctcaggtgatccacctgccccagcctcccacagtgttgggatcacaggtgtgagccaccatgctaggcccagattggcttctgtgtgaggatgaagagtaataggaagatagagtggtgatctaatgtcaactgtggagggagtgggaggcaggtgttcgcagggcacagctggtttcctttttgaatcccacacagtgctggggcagtttcatagcctgtgaccacacagataggaaagtgacacagcaacaccaggcagattcattttctttaaatgaggggttcaaaatagaaacacaaagcattgagtattgagaagaaatggatcttcaggtttggagggaggccgatagagagtgtctggagttgccaacgtcctctccttgggtcatgggtgtgtgtgtgtgtgttttcttcttgttgttgggttttttttttttttttttttttttttttggcttttgcgcctatggtgacttttagcgaatggatactattgaaggaatgtttcacttccaaatccagatctctgacttcccttgaaaatttggagtgccactcaagtcggccgctctgagctagaatcctggtgttcagaattggcaggaagggcacaggggcaaggtataggctcacgtctccacattctgcacctcccaggctcctgccattgatgtgagcgggttcctgtactgcatgaagcaggggtttgcatccgaaacaaccacccgtgctgaatatgtaggtgatacgttgatctgtacagcaaaccaccatggcacacatttacctatgtaacaaacctacacatcctgcacattgtaccctggaacttaaaagttggtgaaagaaagaaggggccgggcatggtggctcacgcctgtaatcctaacattttgggaggtcgaggcaggcagattgcctgagctcaggagttgaataccagcctgggcaacacggtgaaaccccgactctactaaaatacaaaaaattagccgggcgtggcagtgtgtgcctgtaatcccagctattcgggagggtgaggcaggggaattgcttgaacctgggaagcagaggttgcagtgagccgagatcatgccactgcactccagtctgggtgacagcgcgagattctgtcttcaaaaaaaaaaaaaagaagaagaaaagaaaggaaggacagatggaaggaaggaaaagggaagggaaaggaaaggaaccagctgcaaaaattgtcctaactgagcattactgtaacatagaacagctgaaacactcctcaaagctgagaggagggtttgggagagaagcaggctgtggttgtgaacaggtgcctcctccaaaaaaattctcttccttggatttcaaaatgacccccgttgacaacaaagcctttcacgctgtgtttattttttttcaggtctaagtttcccccaggagattttttttttctaaaggaaaaggcagagaagcccccagaccggagccacaatcaaatgcaaatatgacaataggacccatcctggagagaaaaagccttctttttaattagaagcctggaaggacataccctttaattgctgcacttgtagtgtcagggttatcaatatccgtggctctttcattaataaactggcgagtcagaaagcagcaggagtgggaacctctccccacccaatcccctctcacgccccaagctctatttaatcaactgcagactcaatcaaatggggaaaagaacatgtaaatcagctcattcattctgctggccctaaataggtagaaggaagggaaacatgaaagggagccttcatctgttttcctgcagatgcccggctcgtggttaacccaagcaagaggtagttaaacggccccgcagattgccagtgactccgggaatgcctaggtttatgtatggattaacacagtgatagaccctgagtagcaaaagacgaagactaattacctgacagagctcccctccactcgcctgggtcattgaaattaatttctgctttcaagcttggcagaaagcagctgcagaatttcagttcaatacttaaattaacggggagccgaaattatttctgtgcacaggcagtattagaggagtggcttaccaaatagatcttgatcgcagacacggaaaaaaggattattcctccccttttatcaagagccgtaagtccttggaaaatgcaaagagggggaaaaagaagaaaaacagcaacgagtttattggagagttaacacttaaatactccagtacattgagtgtgacatgcctgtgtaggagactgtctgtcccccaaataattgacaatttctctccatctaacaagaaaatatatggcacttttatatatacttgaattggaatccctaatccagagataatttgtgaatatccattctatagcatcccatgttgtcaagaaggtgttgacttactgcaaggttaaggaaatgggtggagaatgtagggaggaggtggaggataaaggataggactaggaatcagagttgggatttgaacccagggcttctgtctccagattccttgttctgtccctttatgctgactttccttttttgctcaaagtctctctccttgcttctttctctttgggctccctgcttttatttcggccctgatggaatctgtcgactttactgagctccatgtatgtgcaccaggtcagattcaatgctgcctaggtccacagtcctcagttatttgttcctgtgattttcgcgccaccaggagccacttgttggatgagatttccgggcaagttgagtctccatgtttttgtcgtgggctactgccagctgagatatggatgaagactccctttcatgtttcccttctttggtgtccatggcagttcccacctcgaccgctatggtatttcttttgcttctgctgaggctgtgtgtgggtgcacatcaggatacctcagtggggaactcagggcgtgaggcacactcatgacagatgcaggaaaaacatctcttttctaactgtccagctctttaggattaggcaatactttaataatcaaccaaattctggaatcctactgccaaattatggcactcatcctacttggtgtaaaatcctgggatgatagcttataatagtaataataagacctgcttcccggtgattctctaaggattaaatcagttcatggagatgaaatacttaaactgtgcctggcacaaagtaaatgttagtgctactattatccctgctgctgttaaccccaactagataagccaagataaggtgctctccattgtttacctgaacaggcagaaaagctctatgcagctatccagacccaagaggatccgacagctctggaacttgtaatatttgcagcatgtcttgccctcttaatgtctaagaagtcaaaaaaggacacgtatgcctagaaaacatgaataattatcatctatcaaatttttaccatgtgccaagcatagtcatatttggctaacgaaaacaacaaaatcaaccgtgacaaggttttattagtaatgaaactgaggcttctggaggatctgtaactgttgcaaatttccagtggctagttcagggacagtgccggggcttgaacccctgtctctgtgtctcccagctcataaggtgtgctaccaagtcacccatgagtagcaattaggcgacttctaacatgtccagctttaaacctgtgacctcaaggcaaatgacttccacatctcattagcactccccagagccttccagccccctgtaggagagggaggttaatcagccacgcgctgaatctgcttataaggctgtttcatgtatgatttttatatcttggctcctaataatggccccgttgtaaatgattgtctcactatgatatacgggttccttaccttctaggaactgatttaaaaggaagccctagacttcttgtgcctgtagagtttattcatatcactctttgcttgctcagcagttgaaatgggatggaggaaagccccctaactccaaaaaaaaaaaaaaactttcttcccagcctgagacagttgccataattagtaacctgcagctcccttgatatcttgatgatactttattaaaacaaacaaacaacaaaaaacacagctgggtgcggtggctcacgcctgtaatcccagcgctttgggaggccaagatgggcagatcacgtgaggtcaggagtttgagaccagcctgaccaacatggagaaaacctgtgtcttctaaaagtacaaaattagccagacatggtggtgcatgcctgtaatcccagctactcagaaggctgaggcgggagaatcatttgaacctgggaggtggaggttgtggtgagctgagatcacgccattgcactccagcctgggcaacgagcgaaactctgtctcaaaaatgaatgaatgaatgaatgaatgaatgaaatactacttctccctgtcctccccaccctaagcatctgatcagacaggtagtgctggtggacagatggacagacacctaccccatatgtcacctccctcctctatgcaaacaaaaattttaattatttctagaatgacttaggagagcaagtcatgtgggatatatagcgtcagggagcgtattttcaaaccaaaaacctgggcccttattttttttttctttttgagacagagttttgctcttattgctcaggctgctgtacagtggggcaaactcagctcactgcaacctccgcctaccaggttcaaatgattttcctgcctcagcctcccaagtacctgggattacaggagcctgccaccacgcctggctaattttttgtacttttagtagagatggggttgcaccatgtttaccaggctggtctggaactcctgaactcaagtgatctgcccgcctttgcctcccaaagtgctgggattacaggcgtgagccactgtgcccagccaaacctcggcacttttatccaacaaatatttatttcgtgactattatgagtcaggcttaagaatacactagtaggtacagcaggagagcatgtagaagaggatagatgtagaaaatcgggacggcatgttaggaatatagataggaattactaaggaaaattgtatttttgtggaattctttgaactcgttactattagtaaacggtgagttttggttctactcttcaatgagtttaagatgaaggaaatcattaaatagtgctttcttttcttcaaaagttgggttgcattgcatagttaaagttctttaaattcttctctaaaccccaaggctaagcaatatacaatctagttacaatggtctgcttgctgttaccagaatctgtcaagctctttcctatcgaagggttttttccatgtactggtttctctcctgcgtggtcttgttctacccttgaggagggtaccacctcctcattgcttagttgtcagtataaatgctcctttctcagagaggcccatcctgaccatctgtgtttttttcctatcaatgctttaacaaatgaccacccatgggtggcttacataccatgaatgtcttctcttaccattctggaggtcaaaagtccaaaatgggtctgtcttagtccttttgtgttgctataaaggaatgcctgagctgggtcatttacaaaggaaggaaatttatttgtctcatgtttctgcaggatgtccaagaagcatggtgccaatgtatttctgatgagggcgtcaggcagcttctactcatggtggaaagtgaaggggagccagcatgttcagagaacatatagggagaaagggagcaagagaggggaggggaggtgccagagactttaaaagaaccaactctctgggaacaaatagagggagaacattaatctagccatgagggatccacccccgtaacctagactcctgtcatcagccacggcctccaacattggagatcaaatttcaacatgagatttggaagcaacagacatccaaactatagcagggtctccttgggccaaaatcaaggtgttggcagggctgggctctgggggcttctggggagaatttgttctgactttttcgatttctggaggccacctgtgttccttggctggtggccacatcttccatccttaaaaccagcagtgcagcgtcttcaattctgtccctggctctgctccttctctccccctcctctccccctttgtcatctttttaggtttatttgtgaccttttagatcctttgtgactgcattggtcttccttgggtaactgcgcatactctcctcatgtcaagaacttacatccctctacaaagtcccatctgccatgccaaataacacctttgcaggtttcagggtagagcatggatgccttttgattttgatttggttgtttttggtagagatgatatcttgctctattgccaggctgatctcggactcctgggctccatcaatcctcttgcttcccaaagtgctgggattataggtgtgagccagtacacttggccttttggcaccattattctgcctgccatcctgtcctaactaaagaaagtaaggtccctccatcctccatcttagcccttctttccttagcctcctaacactcaacgcaatttatatattttaattttttttttgagacaaagtttcactctgtcacccaggctggggtgcagtggcgtgatcttagctcactgcatcccctgtctcccggattcaagcaattctctggcctcagcctctctggtagctggaattacacgtatgtaccactactcccggctaatttttgtctttttagtagagactaggtttcaccatgttggccaagctgatctcaaactcctgacctcaggtgatccgccctactgggcctcccgtagtgataggattacaggccattgtgcctggcgtatatattttaaattttatttttcagtttacttggttttgcctccttctagaactagaacataagctctctgaagtcagggaccatgcctagaatcgccttccttttatctcccatcagccgaaactaactctgctgtgtcacgctgtgttaggctgtgttggctgtgagtaagagaagtctcacccaactagctgaagcgaggtgggttggaggggggatgccttgtggaagtgacaactctaggcacgtaactggctcagactctgctgggcccagatatacagatgtcatcaagagtctttctcttccttttgagcccagctctccctttgtgacccagcaacttccttccccgatgatggccaagccttgaggatgtgaaactgcccagtgccccaatctggagtccaccatcctgggtctagctggggacatccttgaatcagcctctgggaatcactgaaccaacatgagtcacttgctactgtgagatctcagaacacatggatcaggacagagggcagggctgtttccccaaggaaatccaaatgctttacaggaaggggagtggatgctggcccggcccaggcgaggatgaggagtaactgagctgcagaccattgtttagccctccttccacctgggagactggctgctggttctcattgcttctgtgggtctccaggtttctatcattacacagattagcacacggttccatgatcatggacccgttcagtacacaatgaaatcatttgcaaagcaccttggggtctgttagagaagggaatggatgtctgaggtatgctaagcctaatctccatcttctcaaagctccactgccactgtcccgtaagggtgggcagattcctccccattctataaaataacagctaccatttcctgagggcatactgagtgctgacaggcacatcaacatcagaccatcaccttcttatacctcaaaatagtctgcagggtgactcagaagctcctggctggtaagtggcagatccagagatgaaacccagatctaactggacccaagacagaaatttctagaacagaagccacaaacgtgttagctaagtctggttatgtcaagtggaatatttctggctttgggggatcccagctctttttttctctctcactctgagtatttagaggcttttattgctatttttctaaaaggcaacattagtaatcaactttgccaaaaatttcatatgaacggtgggcttttctttctcatttgctttcgcttagtattttccattattcatttggcttcttgaaccctccctatctgtaccccacacttactcttattcacccagaacaggtgtgtgccaccttggagaagatgaagccagagagaaaatcagtcagacaggaattatgttgaaaggtgactgaatacattaccacctcccaggagttgaatgaaaaacggctatttctttaggacgtcaaaccacctttttcctctctaattcatgcatatccctatacaaagacccaaggtggtgaggggctggtttttagatagtctggaggccctctgagaatgcgaggcccttgttgtaaggaaacgctggtgggtgctcactccttcatcaggagccagccggctcccctgcacttactgctttggggaagagtttttgtcaagatcatttttgcagatggttgtaaggtaaacagtcactggtccctaggatatcttgctaatgagacaccaaagatacacatggacaatggccagaccatattttgtcacagaatgccgacccacaagctctggagcagtcaactcagaatggtcaggacttggtcagtaatgcccatttttgctaaattttgtccccacttccaacgcaggaccaaccagagaaagccacatatgctccccaaaccaatcatacaggatgtcctggtctagggagcccacctccggcttccccatgtccacagcctccaatcggagcatactggaagtcatccactttcttttttgtttaaccataaagctttctttctctccacctcctttgagcctctgccaaacacaactgatggtggctgactgcctggctgcaggaagttctgaataagtgacctctatttgttattatttgggttccctttgtttatttttacactagctttgcactaggttaattttttcccacatggcttttcctgtttgtttctttgattgtttttaattaataattagtttgcttatttatttgtttattttttgagagggagtctcgctctgtcacccaggctggagtgcagcagtgtgatcttggctcactgcaaactccacctcccaggttcaagggattctcctgcctcagtctcccaagtagctgagattacaggcgcccaccaccaagcccagctaatttttttggttttttttgtattttagtagagacgggatttcaccatgttggccaggctggtctcaaactctggacctcaaatgatccaaccgcctcggacttccgaagtgctgggattacaggcgtgagccaccgtgactgacctgtttttaatttttttagagacagagtttcacactgtttaccagattggagtgcagtggtgcaatcctagcttactgcagcctgtaggtcccgggctcaagcgatcttcccacctctgccacttgaataggtgggactacaggtgggtaccaccatacccagctgttgaaaaaaaaatggtggggtattactctgttgcccaggctggtgttgaactcctggcctcaagcgatcctcctgcctcggcctcccaaagtgctgggattacaggcttgagctacttccccaggctcttcccccgtttgttaatacataccatgaccttggcctttcccacctcttaggttttgcttactttcccttctgtcctttacttatgactctgcccccttttgacctctgctaaaattatttgttactgttgttatgttattatttcatgtgttaagtctacagtgtataacttgggtttacttatctcatttaacccttaggaaaaccttacacttaaatactcaaagccttgattttgcaggtctgattgatgggcatacagaggaattaaatgaccttgtcttccacatatggtataaggcacagtagtggaagcaggatccaaatctgtgtctgtgtttggatcaacagccctggccaccatcttgattcatttctcttatctgtaattctatggagggaggttccattgtatatttttttctttcaattacagtattatttgtatattggaagcctattgtactttatctgtgtaactgtcgtagcagctagaggctagtaggactggctgaaatgtcagaggaaggagggaagaaaagggagaaaagcaggacaaatgaacgcagattaaggaaaataaaaaagagtgtttggctaacttgcataaaaaggatctcatttttctttgtaacacattactacatacagtgaccatagtgtttctctaatttcttcaggacttactttgaagatgaagaagtatgtgtatccgctttttgtctttcagaataacatactgctgtctgtaaaaatacagataatttctctcttaaattccataagctggagacactgcccctgtttcaaatgaatacagattcattttgtcacctgtgtgaaattggtgtccgtgtgccttgcttcctaggctgtccaccatgacatcagcctgcccatgcaatgcttgagatttgccctgtgactcaacccaaatctaaagcccgagtcgtatgaatccaggacacctgcctgcaaatgcatttttcatgtataggttattcactctggtctttgagattatgtaattagcatatgttgtcatagtgatgtatttattataatggaggtgttctcaggaaaccagatttaatacttttaaatcagaggccaacatggacttttaggaattccattcacagtaaattttatgcgtggtgaaaggttatggaatgggtttccatgccatgtctccccctgtcccacaaatctcagctggcctgcaaaggttccactgtggatttttgccagccagccacgctgatgtagacagaatatttcggatttatattattgcttacttggcacatcttccattggaaatggaatagagaaaaggtggcttggctgtttggtttatgtcctaaaaccttatcgtaatgtgattctccttaacagagggattcgtaagcttaggactgatagagatttggcttttctgctgttggattgatagctccttgactgctgaagccattgcccatctgttcaactgttgtattcacgaggaggttagacccctgacccaaggcccaggtacctggctttcctcagttgggatcagaaggccacaaagttttcttatattttaagcatcaaagtagcaccactgtacagcatctttacttaatctgccctctttcacgtgtgtgcatccctggcatgcttaaacaagaaaggcaaatgagagagagcgagtgagtgcgagcgagagagccctgaggtgccagaaggctgtggttcctttgtgtctacagaaaagatataacgattgaattagactcttaaatatctgtggatgtcaggttgaatacaagcagctattcagtgttttactctggcaggagaacaagtcccctggaggtcagaagccatgcaggtccctggaagtgtgagcagattgttaaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagctcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatggcaggcacagggatggttgccattatcagttacattattatgaggattattttctacctagatcaggtataaggtggatgtattattggcattcctaggactgttttaaaggaagtacctatgaggcctcatgataagccagatgtccagaagccagcttgagaccagggctcctggtcacttaaaagatgtttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcacctgtaatcccagctactcgggagcctgaggcaggagaatcacttgaacccgggaggtggaggttgcagcgagtcaaggtcacgccagtgtactccagcctgggtgacagagcgagactccgtctcaaaaaaaaaaaaaaaaaaaaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcatataagtaaattatatgattggacccaggcataaaacgtgatttgactcccccttgcccatcacagttctggagttcacatatcatttgttactttgaaaaatgaacttttgttatttgattatggtaataaataatatacatggtagaaggagaagaaaatgaagaaaaatttagaaacttggacagaggaaaatgaaaatgttctattaattccactagcatgagataatcactcttaatattttgttgcatgttcttttctttcttctgagtgatagcatttttttcaacaaattgggctcgtaatatataggcacatagatatataattaaaaaaacaagaatttctcatgtcattaaacattgcttgaaaaaacatactagtaatttcctaagattacaccatgtaaatgaattgtattttatgtaaccattccctagtgttggatagctaggccatttataatttggacactattttaaaaaataactcaggcttattttactatttatttttgccttacactttttgtaaaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagaccttctgcttcctctggacactggcgcagcctggactagcagttgccagcttgggtttggacaacctccgaccttagttgaaaatgaccctgtgtaggacagaggagcaagtggaaagaacctgggtgcattgtggcattttagagccactgattcagctgtcctatgggcctcctaacccgaacctccactggtcatgaaataagctgttagtttggtgcaaaaggaattgcagtttttgccattgaaagtgatggccaaaaccacagtaacttttagcaccaacttaatattttgagttgggtttgaatcacgttgtctattacatgcagcaggacacatctctaatcacgcgagaggtctgagcaaacgtcttcacatttcacactgcagatattcttacaaaaggcaaagcagagatccagagaaattaagatctgctcaaggtcgtatccagctttgggaaccccaactattgcagaaatttctgaagtcgtcatattgctacttaaagcaaaatgccttctcctaaatccaggtagagagaaactctcaaaggccagggtctggactcaagatgagcacaggatttagaatcagaaagtgtgagttcaaattgccttcggctcttcacctgggtgggcgatttgaatagagctcacagccctgaaaaccctggttttcagattctttattggtaaatgaagtcagcttagtgatatgagaattatgaaacataaatccctttgtaaaaatataaaataatcttacaatcatcatcgtcatcctcatcatcgtgttccttcacaccagcggtatttatggtatttatcaactaactgctgtgtactatgctctattgaaaatgttagcaatatagtaatgaacaaaacagatgttatctctacccttatggtttttatattttaataaaagtggcagaaaagaaataggtaaaacaataaactgagctctttggagaagaggcccacgttcttttcagattctgatttctccgtgatataaatagttttttaggtgatcacttgtttttaatgtacctacctatctatacctttctctctctctctctctctctgtgtgtatgtgtgtgtgtgtataaaattacatatccagtatgaaacctaaaaataagattttggggcctgtgaatttttttaacctttcttaacctacatcctaattatttgatttgacattgtgatgaaacatactgttgttttgaattttggaaatagaccagtgattcttcagtagggtcgtaaggtcccgtcaatgcagcagtcaaattttttcttggtgggggggatgcatatgtgtatgtgtgtgcatgagtatcttgataatttagaaagattaattaaacattgatcatctatgtgaccacatttaaaatgagcaccaccacatccaaatgtctgagtttacattttgtgtcggtacttgctttggcagaactctgtgcctttccccaagtcttctgtgaccttctcacctggcctgcatcctggtccttatcaaccgtattttacagttaaggaaactcggctcaaactagcttcggggactcgctgtggccataggtgccctaggctgcagtctgagagtgaaactgaggtctcactcccttcatagtctgctctccgtctctgcctcatctggcttctcagggtggtggggcgtgggcactaatttgatttgatcacttagagacaacagcttacaaaatgctaccgagcagtgcctgtcctttctgagaacttgatataataacgttggcttgatctcctcagcctgtgtcttgagggaacaagtaaattaaacaagtaattagatccataatgtttttagaagttagaagatttaaatatatgaatctcatctgagtgtgcagccttttgtctgctgtgtttcctgccaaaagatctcttgacaggaaataaacattaaaataatctttaatcccttgtttggtctattaccattaacaattgatgcactttaattttgtggggttttaactacaaaatggaacggctaagtagtgataattgggtttggaattatacggtcatttatatcaacagagatgcaaggggctgggagggagggtgattaattatttactatttcctggctgtggttcctattatagaattttctgatatgttcttctgtgaacaattatcaccaaatgaaagtaaacaaatctgtgatttgaagccttatttagaagttagtctatatttaggtgatgtgggcttgattttcacagaccctgtgggctgtctgtgtgtgttccttttctcagtaccccagctctgtattcgagcgtggttatctttgtgcatcttaaaatccacaatgcacagcctggggagaagccttggttttgccagggggaaaaaaagagaaacacaacattgagtgaggtctagggtgaataccaaaggtctgttttgaaatgggggtgtgggttattcttctctctttctgatttgcttcagtacagtatgggatggggaagaatcaaaattattatgtcaacatgaggatgaaagttatgctctgttgtttctcataacatttgtgtgtgtgtgggtgggtgggtgtgtgtgaaaggtaggatcacctctctgtgcctcagtctccccatcatccttcggtggtagatcaatgctatctgatgaggccttttttgggatcacccactccaacatgcatgtcctttctctgtcccctcctggtgcctgtattagtctgttctcacattgatgtaaaggactacctgaggctggctaatgtataaagaaaagaggtttaattggctcatggttccgcaggccatacaggaagcccagttagggaggcctaaggaaacttaaaatcatggcagaagatgaaagggaagcaggcatgttctgcatggctggagtaggaggcaaggagcgaaggaggaggtactacccacttttaaacaaccagatctggtgagaactcactcactgtcatgagaacagcaagggggaaatcagccctctgatccaaccacctcccaccgggcccctcctccaacattggggattgcagtttgatgtgaaattttggctgggacacaaatcccaaccatatcggcacccactgagcacatcctcgtggatcttcctggctctccttacaaggggttccttccaaacccaagcgccacaatccttaggcagattgctctgacacagaagactggtgagttctagacttgatgtgtttcatgggaaacaggaagacatttaggggaggctgtagatacacagccgctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcaattgcgcaattcacacaccaggctgccactttggcccctgcgtcaccttcaccaccacccaatgtgtcctgctcatcactgaggtttgtcatttttactctgagtctgtccattgtcatcatctccaccatcaccccttttgttttcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctgtgcttcccgactcccagggccctgcagcatgtcaagaacaatattggacaagcttgtcagtgagggtccaggtggttccctgccactacgatgcatgctggggtcagtaaaaggagaacacagaagaatcagcagacccagagtctaacccctcctctagttaaagacgtgaccctggccgggactgaagccagaggcccacagcctactggacctttgtttcttgcagtcaggttctgatgacagattttagtcccctcttgaatttccttggatgtgatggaagtgattctcagtggacaagaggtcacattgccttttctagcttggaaggtggcgcaaataactgcttgaggctccctctcttgggccaagcttgactctggattttcattgttgtccttttttattaaaacaggttttgtttttttgtgtgtgtgttattttgttttttgtttttttgtttttcgggggctggagtagtgtgcagagcctggcggtgattgttctcattagaaagtatagtgtaatactcaataaattacttttgttctcaccttgggaagtggactcagaggccaagtgactttgatttttcactttatcctggagtttctcaaccttggcactattgacattttaggccaggagattctttgttgggggggatttcctgtgagttacaagacattaagcaacatcactggcctctacccactagatgccagtagcatcttctatttcctcaagtctcaaaataccaaaaacatttgtagatactgccagatacccctggggaacaaaatcacccctggatgagaacccctgctttatcctcttacagttttggttctttccatgagaaagtatttttaatagcaaagtaatgaacaagaaagtattaataagacccaaataataatataaactactactttactaatggtcattatgtgccatgccctgctctaaacacttgccatgtagtcactaatttaatcctcacaagaattctgtaatgtagtgtagtttcccagggcttccttgaaaacgtgccatagactagatagcttgaaacaacagagatttattctctcacagttttggaggccagacacctgacatcgaggtgttggcagagttggttcctcccggggctctcagtgaaagcctgctccgtgcctctcctccagcctctggtggctgccattaatccttgacattcgtcggcttgtggcagcagaaccccagtctccgcctccgccttcacatggccatcttcactctctgtctttgctcccttttcctatagggactcaagtcattggatttagggctcactggaatccaggatgacctcattttaccttaacaagttgcatctgtgaagattccatttctaaataagatcacatgctagggctgggcacggtggctcatgcctgtaatcccagaattttgggaggccgaggcaggcggatcacttgaggtcaggagtttgagaccagcctggccaaaatggcaaaaccccttctctattaaaaatacaaaaattagccaggtatggtggtgcgtgcctgtagtcctagctacttgggaggctgaggcagaagaatcccttgaacctgggaggcagaggttgcagtgagccgagattgtgccactgcactccagcctgggcaatagagtgagaatccgtctcaaaaaaaaacaaacaaacaaacaaaaaaaaaacaaaacacatgctggtgcacacataaatttggaagaaatgctctttaacccagtatgagcacgtggtattcttatcctcattttacagatgaggaaattgaggcacagacagattcaataactacgtgactcacagagataaccgtgtagcagaatcaggaattcagcccagttttttcagttgcacagcctgagctcctaaccatcgcgcctggggttctcaaaggctcgtccccaagcgacaacatcagggtcatctgggaacttgttagatgtgctcaccctcaggctcgccccaccccgccagacttcctgaaccagaaactctgggagtagggctcagcaatctagttttagccctccaggggattctgtggtgcctaaagtttgagaacttctgatcaaaaatgccagataagaaaaaaaaacctttcgagacatcatttgaatcaattatcaaatgtttccaaagtgcacttgctttgcaaagcactgtactactcatctctgcctccatcggagcgagttcaggagagttgtgtttacttttctaaaggagccttttccttcccattttaccagtgcccaaaagtcttagaaaaatgacaatgttcatatatttgcccacatgaagatagaaagtgtcatgtcaaagataaagggagaacagcattttctttttttacaagtcactcttacttaaacacacagcatgactctccttacacatttatttcggaagagcaaagtccgggtccccaggctcaactatcagccgccttctcatcccaagggctgtcaccaccagaaatttaacatgctgttagtgcatgcaaaaaaaagcccagtaattgtagggctcatcagtacattgttaattgatcctcatttcctattattttacctcaaagcaaacacatcattcaccatagtgacaccagagttgtttatcttctctgtgcaagtgtgtgctctttttagcaagctttttggatcctctgtttcagagggcctttcccatctgtttactattgtggactgtgctgctttttttgtttttaattacaggttatataaaatattgtcagcaggagggaggttattattaccttaaagaataagtggtagatgcggactggccactgtgagcccatcactaaaatgcacttccgtacactaaaggtccctcttccctggcagacagtggttcattttatttgaggaggtatgttgtgggcttggggaaacagaaggaaattggagacattgatatgcttcctgagaggtggaaggggccacttaacacagctttcatttttcagttgccagtgggagaggagctggggtgggcatataatgagtaacattcaaagctccttctgtctttttttcagagaattcacaaaacaactcagggcctcctggtcctgcaaaagtgtttactgtttatttgtgttgtttctgcttgttttgcttgccaccagctccctactcacttgggggaaaataacccatcaaaggaatagaagctcaggataaacgtttcagacctttcagtaagatagtaaaatttctttcattcccagacctctctccaaaagaggcagccatcattaaaagtttgttatggattcttccagaaacgttctatgcatttagcatcagttgcagatatggatagccttttcaaaaaatgcatgcaactgagactattggctatgttttgtttattacctactttttccatttaatagtatcttggagattatttggtaccagcacatgtagctcaacctcctaatactgcatgacggataatatgccatcacatggtgtcatttaatatattcattcctatttatagacattgaagttagatccatgtcttactattacacatgacttagtaatgaatgttcctgcatgtatatttggtctgcttgagcaaggatattgggagggaggatttccagcagcagaagtggtggaacaaaggcactgtgtacacctttgaaacaattaacttcaccaaaattactaaactgtcctctagaatggttaaaccaatttcctctctaccattcacacgtgagaatgcctgtggccccccagaaattatctccagcagcagcaacagagaggactggaatgccattgacaggtcccacaagtcagcaatcagcacgccattttttaaaatttatgttgctattgtatcgtaaggttcttctgaagcgaccacttcataacactgtgtagtccaatccctaagctgggcaatttttttttcccctttcaatacatcacattgattttctgtatgactttatctgcttaatacaaagtgggattgaacagttatttgtctggatttgatcattccttattaaacatttatgatttagctttcaccgcggcatcttcttgtaaggtgtttcttatttttatcattttccgtaaaggtaggattgtgttgacagccctgtaataaatgtctcttggaagagatgtgttgctgagaggtggggagggggtgggggctctgtgcatggaatggggggaaaagcttcagggaagggcagtgcaaattgtttctggactgatgccatcttttaataatagtagttaatagactgggtacaatggctgacgcccgtaatcccagtgctttgagaggccgaggccggtgtatcgcctgagtccaggagttagagaccagcctgggcaaacagcctgaggcaaaacctcatctctacaaaaaatacaaaaaatcagctgggcgtggtgatatgcatctgtggtctgagctactcaggaggataaggtgggaggatcatttgagcccggtagatggaggttgcaatgaaccgagattgtgccactgcactccagcctggatgatagagcgagaccatgtctcaaaataatgataataattgtagtagtagtagtggtggtggtggtggtggtagtagtagtagtgaatgccctgactttggggtttgcagtaagctaggattaagtgcttcacagtgaggcacagtggggagctactctgaggatgaattgcctagtaaataagtgaggtttgtataaccgaggccagatcttagaacctcctgctatctgtacatagaagaatgttttagtcagaggcaaggcaaggtcaccaggattcactgagagtgttggtcagcatttcatctgcatatacaggactggaaaataagagagcgcaatgagacatctagtttttttctctttcgtttgttctgtttcccactgagagaattttctagctttatgtggagaaaacagtattggaaattattactcagttcaagaaaacctcactgagcacctaccatgtaggtgctcatcccgataccactatcaggccctttggaccagttgcaaggatgcaggatgaggaaggcaatgtgagaaaacagaaggagcaccaggcagtcgtgggcttgatttttattttactattttttaaaaaacataaaacaacatacattcatcattttgctttctttggatgaagaattgagcctggttcagcatctcttgcaggctgtaattgagggtggtcattgactggggctggattcgggaaggatccacttccaagctgcacagttgttggcaagatgtagtgttttggtggttcctgggctctgggactcagctttttggctgttggttgttggctgttgccacatgggcctctgcaaaaggcagcttgtaacgtggcagctgacttttgtccaagtgagaaggtgagagtgcaagaattggtgagagagaccgcagccagggtgtttttttaacttaatcttggaagtcacatcctatcgctttggttttttgactgagattattcagtactgcaatagtctccctttaaagtggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatggaatcatacaatacgtggccaactgacttctttcatttaatgttttcaaggtttgtgttatttcatgtattaatattatgttggtgcaatcacttttgaaccaatctaactaatacttcatccccttgtatggccaaataatattctattctatcaatatattatactttgtttatccattcacagttcatgtcattcccactttctggctattatgaataatactgcgatatgaacatctggttacttctggctcttatgggtaacacttctataagcgttgccacaggttgcttctgatttctattatgagtaatgctgctatgaacattcatatacaagttttagggcagacttctattttcattccaatatctctttatggcatgtcttagcagtgatgtctatgacatccaggatgtgtcttgacatgtctgacatcatttaaataaaaataaagtagggaaagaaaacagatagtgattgtgtgtgtgatcagtgatggcttttgaggaggtgacatttgaactacaccctgaatgaagagagccatgcaaagacctcagcaaagaaaatctcaagcacaggtgcagcaagtgcaaaggccctggggtggaaacacactcgatgtgttcaagggagagtaagtggtgaatgggtttggagccaacagggataatagacaacgctatcaagaggggggccaaccacacatgtgcagccactgtatgacgtctggattttccttgacttatggtgatcactattgggaggtggtaagcaaacaggtgacataatttgaatcatggttttaaaagacgccatggttgccatgaggaggacaatgcgtaggaggcaggagtgaaagctaaaggatatgctgggaggtgaccctggagttaaagagagcaactaaggtgaccaggtgacaataatggagatagagaaaacaggatggattcaggaaacatgaccacactgagcatattcaaatgtaattgtcagttttcgtgtctccctcccactggaccacaagcccctaactcttcatgtacacaccctgactcccagtgtgggctggccacccaggaggcacccagtttatgtgtgctgcgtgagtgatgtggaatgactgcccacgtaggaagtggcaggttggagaaaaagcagtcacagctcctggctgctgtggctgctttgagcttcttcctcgatcaggctggatcattaccagcctgtaccctcaaaggatgcccttagtcctgtcccctctcactagcagggattccaagcttgtaaataaagtctcccacttaaaatgtgagcagagtgaagagctggcagtgtcaaaactctgtgtccagatgttttatgattttcccttttccagatgagcccggtgtatccgtatcagtgtgtctaggaagaccaagcatgccgaacggccagcagagtagaaactctgtgtgcccatccattatgtactccctgaattaggctccttgaggctcaattattaaagtgggatttttcttaattattaacagttaaaaataggaaaatagatttcaaggggaaaaaatttgcaggcaacaagagtccaattctaaatgtgtgcatgtgcgtaaaacggaatttgccaaacatgaataggcacttacaatgtgactggaattggctctgtcatgtgtcagcctaatagcctaaaccctggttcaatacaatgaacttgggaaggtttgcttaatgaaagaactgacgttttctgtgcagcggctgcattcatcagcctgcatcctgttcattacactacaaagggctgccaatgggaattggtaggatcatctattaggtaaatgcgatggggacaaaagatagcagagcccggggctttgtggaattttctgtggtggtccgggttcctggagtagggagctgtgatgacgggcaacagatttccaagttggcacgcgggcttctggagtcacgggctgaattccggcactgccacatcttgccacgcacatcctaagggagtgtagagaagagagttttcagttatgcatgacactgccttacccattgtggattcagtagggatattcataactgtgaatttgaatataactattaaataattgaattattattattgagttactgaatataactattgagttttccctctccatctgggcacatgggaaggccgtactttcctgacatgtgatttgctgtggcgagtggaatctgggggcaagagacgtgtgtctccttgaggcagaaactttaacagattccagcctgctgcatcataatctcctttccctctaccacgctgactggcagtattccagattccgattgccctgtcagggtgggtcctagtggtaggacaaaagcaagaatcctgagctgacccaagacacacatggaaacattaattgtgcttctctgatgtggctttaagatacttgctctgtcgcccaggctgtagtgtagtgattccatctcagctcactgcaacctccacctcctgggttcgagtgattctcctacctcagactctcaagtagctgggattacaggcatgcaccaccatgcccggctaatttttgtatttttagtagagatggagtttcaccatgttggccaggctggtcttgaactcctgacttcaagtgatctgcccaccttggcctcccaaagctctgggattacagacgtgagccgctgcgcctggccaagatactgagatgtgggggccaggcacagtggctcatgcctgtaatcccaacactctgggaggctaaggctggaggattgcttgaagccaggagtttgagaatagcctggttaacatagtgagagccccatgtttctaaaaatttaaaaaaattagccgagtgtggtggtgtgccacagtagtcccagctactcaggaggctaaggcagggggattgttggagcccgggaggtcaaggctgtatagtaaactgtgatcctgccactgcactctagcctgggtgacagagcaagacactgtctctttaaaaataaataaataaattaaaaagacactgagatttgggggttacttgtaactgtgtcataacctggctccttactgccatcggcatgcctagagggatcccagttttacacatcagaacaacccaagccccagtgtgtcacgccattacatgcttacagcctatttttacaaagtttgaatattgtaatttgcctttaaaaaattgttttaaagatctgcctaggtcagcaaattttatttactctctagaaccatttgattggggtactgccttaagaaataaagcagattccttcagtcgcatgtgggcctggagtcactggaaaatgcagacaaaacaagatctgctgattggcaaggtcatcttgggaagggccatcgtgcagtaaagagcaggtccattaattcaggggggatttacatcagttccatctgcctctttcctaatgggactgtttggttgtgttctttcctggagagattagtgattgaaaggaggagatctagaaagaagagataaaagtttacatttaattttcatgccatgcagcgttctacgaaggcttcctaaggaggctccatactaaattcagacataagtcagaaggcagcttctcccaagacactgttgatgtccagggggtgacagttccatcacaaaagggggttaaaagggtttaggggaagtttagttgtcttccttttatctctaactctaaaacccaactgctggctgaattaaaagtctcttacataatggtcagaggagttttgagtatcggatctttgtgtacttgctttttaaattcagtcacgtcttaaatagtacttttcactctcctcctctccacaccactttatgtgtttgctagtagcttccatgaaactctatgggtgaacatgtctgcaactctttggcatttaaattttaggtttctgcccctcgtagcagactatctttctagaagcagagctgtaagtctcttttaacaccattttcaagcttggacaggctgacatttttattgaatgggttatctcaatatatatctacttttttgcatcctactttttttagaaaattaaaaatgatatgatgggtgtggtggctcacgcctgtattcccaacactttgggaggccgaggcgggtggatcacaaggtcaggagttcaagaccatcctggttaacacggtgaaaccctgtctctactaaaaagtacaaaaaattagccaggcgtggtggcaggcacctgtagtcccagctactcgggagactgaggcaggagaatggcatgaacctgggaggcagaggtagcagtgagccaagatcgtgccactgcatcccagcctgggcgacagagtgagactccgtctcaaaaaaaaaaaaaaaaaaaaaaagataatgatgaaaataatagaatattgatgagaacacccattactctgctcattgttcaaatgaactcatttgagagctctctcctttgtttctgtctttctctcgcatcagcttgcatctgtttgcctatgctataaggcatcagtggttaccaggcagtgttgcattttttccatcccatacctctgtgtgtgttccttatctgtttctaggatgtgccctctgccccgtcacatcacactctgtgctgctctcagccaaagctcttcttaaatacactagccatcaaaaccatacaacttggctgggtgcggtggctcacacctgtaatcttagcattttgagaggccgaggcgggtggatcacttgaggtcaggaattcaagaccagcctggccaccatggtgaagccccgtctctactaaaaatacaaaaaattagccagctgtggtggcacatgcctgtaatcccagctactcgggaggctgggacagaagaaccactggaacctgggaagcggaggttgcagtcagccgagatctatgccattgcactccagcctgtgtgacagagcaagactttgtctcaaacaaacaaacaaaaaacatacaacttaactctcatacccccacgcctgtcttttctcctgttcgacttgactcctcttgggaattccgtaagtactttgagggcaaggaccacaagataaatgtcgtaaggtaaccaggaatgacattccaagattccattctttcctttgtatatccactcatcattcattatattcttactctgggctaggccctgggaacagttgagtaagaacaagcaggaacaaacaattagaacatttagtgtggcaaggggcgtgacaaagttaccaagagaggtaggtgagagacaggagttgttatctgcggggaacaggtgaaggagtgacagcagggggtgaggataagaaggaggaagctttacccctgagaagagcaggcatcagatgggctttggaatctacatgggtgtttgtaggtagaccaccctggaagttgagtgatggggaataaaaggaagaaagtgcattctgaacagagggaatagcaggtacagcagctcagacatgggcaccttcagagcgtgtctgagtcttcctgatgagacacgtggtgttcacttgataactccctggcaggttctcttcatcgggcctccacatagggtatgcgaacctcttcatgtttttaaaagggagagatttaataaaggcaatttggtacttaaaaattgttagaagagctaaaagagtagttttgaggttgaccttcagaacggcttcctgaataatacagaagtgaccctccaggaaggcccttccactgaagctacaactggagctaagcagatggataagccaaaaccacctccgttgctgtggccccatctccaccacaaggaagctggagaagggaccccagaaccggaagacaaaaaacttccttcacacactcccttgctaagaggagaagccccaaagaagctggatatggcccttccctcacatttgctgtcccaagtgtcccatggcagtgcctaagcaattggtgggatggatttgtgtctataaacaaagttgcaagggagtctggaaagggagttttaactccaacttcttcaactagaatggtaggatccaggggcagcattgctccccaggggatgtttttacaatgtctgggatattttttagttgtcagaactggaagcaggaagaagtgctactgtcatctaatgggtcaaggccagtgatggtgctgactatcctacaatccataggacagtacctaccacaaagagttacctacccccaaaatgtcaacgtgcccaggttgagaaacgtgacctagctggaaggtgaacaggaactaaatgagtcagtttcagatatccaacacaaatacgtcacttgtttctgttccaaaagtattataatttttgtttgagctaaaaactagttacagttcattggataattgcctttcatcccttcaatatgtgttcccttgaaatttgcatccatgcatcccacatggcacccctattgattatttcagtgactcagaagacttcattattcaaaataatctctaataagatgtttagggagaaggaaaaataaagtttctctccacgttacgtttttttcttgcacatgtactgctttttcataagcacaatcttattaatagaacaagtcctctcaaaatggttgccttttctcccttcatcctcccccaccagtaatgtagagctgttatttggctcgtttttctttttcctccagaggcaggaagagggaatgaatggtggccaagaattttaaattcctgttcccggccgcccccggaagctccatctttgttgtgagggcttctctgcgtcagtagaggccagctgagctcttattcaccccttattctctggttccctttcaccagcaggtccagctctaaccacagctggagtttaggaaggccaggcagcgtgtgttgaatgccagccactcttctacccagggtcatatccttggatgtttttctgtgcatctgtcttttccgaccctcccgtgattctggaaggaaacacctttccaagctccccagtgaccctggttcatcccggaaatatgcaggaaaagcattatgagcattgcagtgccacatgctgcattggtgtgttacgttatgagaactattagggctgatctctgagaaacttaccagtggtgtgtgatcggaaatcatgtcaccctctgaatgtgggttatgggataaatggctaggtacacaggcttcagagtccagccagccccaggtttggattacagatggttgctgtactagatgaataatgtccccccaaattcgtgtctatctggaacctcagaatgtgacctcatttggaaataaggcctttttaattaaaaaaaaatttttatttaaaaaacagagatagagtcttgccatcttgcccaggctagtctcaaactgttgggctgaagcagttctcctgctttgacctcctaaagtgctgggattacagacatgagccactccacctacccagaaataaggtctttatagatgtaactgaaataaagatagagatgtgaatgtgatcgtactggtttagggtgggccctacatccaataagaatgtccttagcagagacagaacagagacaccgagagaggaaggtgatgccaagacagaagtaaagattggagtggtgccatctaccagccaaggaatgccaaggctgtggctacaccagaagctggaacagagcctgcaagcatttctcctgcagaacccccagaagggactcagcctgcagacactcagatttcaaacctctggcttcctgaactgtgaaagaataaattgctgttgggccaggtacagtggctcatgcctgtaatcccagcactttgggaggctgaggcaggtggatcacttcaacccaggagttcgagaccagcctgggcaacaaggcgagaccccgtctctacaaaaaataccaaaaaatgagccgggtgtggtggggcatgcctgtagtcccagctacttgggaggctgggatggaagcatcatttgagcctgggaggtggaggttgccgtcagctgagattgtgccactgcactccggcctgggtgatagcatgagactgtgtctcaaaaattaaaaaataaaacataaataaatttctattgttttaagacaatttgcctgtggccctaggaaaccagtatagataacttgtgatggtttagcttatttagtacaacaaccctgccccttctagtttttatgataacctcattaattgccggtactctcagagccctgattttcttacctataaagtagagattccctatctcatttggaggtgattttaaggcacaaatgagacagtgtatgtaaagcatttggcatagtgcctgattcagagtaagtgaccaataaatagctacccttactatttagaatgctattatttagaacataagtatatttaagaaagcaccatcagtattcaatttgccttgctaataaaaagggatcaagatatggattgtaaagtagaaaaatacatgtcaattaaatggatttacatcttaaaaagtggtgaggtagacacacaggcactactcacttcattccttctcatctcaacccgttaggatttggccttcaactgggtagtggaaaaaatatgatccttggcagtctactacgcaaaagcaggaacatcatctgcttttgggtagttaagagttaagtatcactttgagctacaggatcatgattaaaaagcattctgttatcttacttcacaactctccacttttgtaaaagtttaggataccggcagggcagcaaatacctttaaatgattttatttaaatgtcagatttaattaaatccatgaccagaagacaaacccaaaggaaattttcagggagctttagaattttccttttccatgttcaaggtgataaccgtagcataaaactgtcccaaccacatgcaaatgcaagcaggggcattcatcatgaaaatacagctctcaaggcggaagtgcttgttaactttgcactctatagccaagtgcgatgatcagaaaatacatacattgaagacaccagaaaatagtgtatggattggtgattttgactaagactggaatgtgggtgtgtgcactcctcatgttccggtttctgtgatcattcaggcatgcacaggtatcctgatgggtagccaggtcattaggcccagagtcggcagtgtagcatggcaagagaagtcattgcatctccaaactgtgcctaaattgcctgtaatgggttctttgcaacttgcagaaccagatcttaccatttgcaaggagaatagctgaaaagatacttaaataaaagtgatcggatgaaattttaaaaacgggaatgaccaaaaagattcccagaggaccgttactggtctgcagccccccattttagggtctggcatttgtactgattatggcctgacagctcttgagtttccaatgataacagccatctgacttgatcggagttctatggattttcactaaaatagaatcatcgccttggtgatggatagaaaaagtaaagcaatacatcctgataaatgctgtgccttcctccttcgtctctctggcggtgaccttgtgcaatccataagagggcaaggctgagagccccggccaccgccgccgtgtgtcagaacttggaaatttaagtagctttgaaacccgtcaatggggtgaagggggaatggcctgagaaagcaatggatcatgcttagagggctcagagggaaatagggtacgctgaaggtcaacgtgcagacatgtcctgaaggaacagctcaagtcctcattctcattcacgggaggctgcggccctgtgaggtgagatcagtagaagagtacaataaaacaggaattttcagagcatgtaatttcttcttggaagtgaaaggcactggagaatggtgcagaataagcactagccttagagagaggatgccctgccccagtctctttctctgagtagcagagagctggctgtgctaggaaactcttcgcctctctaacaccacgtttattctccagcccagttatcttagccaactgtgaacattttgaacactgttgatcatcggtaatgacaccagcaccataacacgaaacccctctaaaacagggcttccaggaaactcacagactagttacatccccaagccttgcatacttgattggaaagagaagcttctggatggttgaaggggaaaggagttagacgttggcaggcacccattagtgttggttacgacttgctaaaagaaaatattaagataaaaattagatcataaatttggagccaccattacgaagcctaaagtgcaaattgccaaacaagtcaagagactcattagcattttatgtaaatcagttattactgttctccacttccttaattatccatgttatttcaatacaaccctttctttgatgtcccaattctatatttaaatagtgcaagatttctatcgtatcctcccgcagaggtttgtgccatgcaaaaaacatgccaagagcagctattttagagactacagggaaatgtttaattggttcatcccatttgagttatgagggtgtattactgagcacataaaatcagaaacatggaaagtactagcttggagaagtttactaaaacctgcaagagaccgcttgaaattttgcccccaagactttttggattctcgatgggaaccgactcaaagagaaatttcgcaaacttcatggaattttgctaagtgattgatttataattgaaatatttggaaataaaatccaacagctctctttcctttggctcagagacttattgttttggttggatgaagagaacacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtcctgcctcagcctcctgagtagctggaactacaggcgtccgccaccatgcccagctaatttttgtatttttagtagagatggggtttcaccatgttagccaggctggtctcaaactcctgacgtcaggtgatccaccctcctcagcctcccaaagtgctgagattacaggcttgagccacagcacccagccagaacttcatagtttactcttattattttctcctaaccactaggttccacacttctggccacctgcctttatctcctgccccataacctaacctgttttaaaatacttattaaacaaagaaaaataaacaagaacaaatggagaatctttcactatgactgcaactgaaaagaggagtaatggaaggacatgtactcttcccatatatttttaaacaattactgtatctgatttttcatttttcattttttttttttctggaagaaagagcagatctggataaagtcagtatacaatgtggtctttggtgacagacccaagttcaagaccaaggtgtatgcatgggtttgttcaagttgtctacccttattatcccctcagtgaaacatgattaaccatgcttaccttgaagagttatcttaaatatttgtgttaatattatatatgtacattacatggtaagtgctaagtaaatggtacatgtgagtctttgctctaggcaaggcgctgtgctgaatgtttacatagatgatcggatcctcatattggatcctcaaaacgttcatcaaaatgggtaggattatttttatgtatatttaacaggtaaggaaaatggggtttctggaggtgagtgactcactcaagatcacgtggaatcaagcagagaagctggggttttaattcagaagttctttaagctacagctgtaattgagacaagaaccgtacactgtagtaagattaatgtaaagatttaaaaaactgttcatatcgttcatctacataaataaataatatttacagaaactcatctctgcagactaaagtactttaaatatttaatctaatttattggttatttatttaacaaatacttttatgggccttgccatgttccaggcacggttgtaagcacttacaactagtgactcatttaaccatttcacaaatatttattttgagagcaagcacgggggtttatgtgatggctccacagagcagtgaaaagactcccgccctactgctcgcaacctcagatgtccctgggcactagcccatctgtatgtctttaaaaaaaataaattaaatttttaaaaacatgactttctggccaggcgcagtggctcatgcctataaccctgcacttagagagggcaagacagaaggattgcttgaggccaggagtttgagaccagcctgggcaacatagcgagaccttgtctgtactaaaaaattattaaaagaaaatatatatatttttttaaatcatgacttttctgatcatacctgtggcatactcattatagaaaatttggaaaatgtaagaagtcataaagaagtgggaaaaaatttaaatccttctctgtcccaccacaaaccatttaaatcaatccaagattttagtggaaagggaaagcatatgatctagtacaaagaattttttttagcttcttctccgctgcttgtttaagaatctcagagtaatccagacgttactactccataagcaaatctgggacagtaatcagacaaccagacaaccagactgagagcccccaagggttcaaattcctgagcgccgtgtcttctctatagcttgctgtcttgttctatttggatataaagctaccatcaagcagaagaagcgggatgctctctacagagtccgaaacaaaacacagaaaattaacctgctaccatcctctaaagaagcgagggtctcagactttgtccccttttgttcctgcattgccctccattcagatcttgtcacttaggccttggtagcatgagctattaacagccctccatatttactatttttttttttttttttaactctgggagttcctgttgcagaaattggatcacttacctaaaaagctccccacccccacctttggtgactggtgggtttcatcaccaggaaagcacattgttccaactcaaagtctacagtctaaaatcatcatcatgtattttcatcaggatgaaatatcgggcactctgctcagtgcaaggttttattaatgatgtgctgtcaggggctggatgttctgcatatttgcatattaaacagctgagtgaagaaacattgcttttattgctgcagggaataaatcagtttaaagcaagttctcatcatttatactcgtttcagctaagtcttcttttattgaaataaattgttgaagtgctttgctcattctttgaatactgatgaactttaccttgataggacctcaggaaaaataatattttcttaaaggtgcagtattgttccatttttgagtattactttaatacattattgataagttaatttagaagtatcaagtgaaaggggaagaaaaacagttttgaataaaaacggtgtttcctctggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtcccctgggcaggtgcatgagggggtcccaggcaatcaggctcttctcaaacctgaattatacccggcctcagggtataggggtcaggcagctgtttgacaggattcttgcaaatgtttttggtttctctgtctactcattacgtacactctgccagaggttgaaaactcaatgttgagattacatacatcctgaaaacactgtttaaataaaattttggcctgcatcctgtttttgaaaacttgcaatggcttgccaacgttttcaagttgagaagtttcacaaaaaaaattcggatttccagcttctttcaaaaacacaggtcaaacatcctgagcctgttctgtggtcagttactcattagcagcctctgctctaggaggaatagttatgggtcctttcagacatgcaacccccaaaactccatgttgtttacagtgtgggacacctgactttcaccttttatgatacctgcctggggcatgcatgtggtgactttttccatctctggtctctatcttatctcttgtgatgaactcaggtctataaagcatttgggcactgcctggcacataggatatgtccagaaaacactagctggtattaaaacagaggaaacatgggaactgagggtggtcagtgacatcacattgtatttcctttatggtgtccttctgagtacagaaccaaacatttcttaggcgtacaatttcctgcctccaaattaatgttatttctaaaaagtagcccgttccactcctacaaatctttgcccaaatatgtccttttcagggatgacatccttagccactgtttaaaatagcaaatttctttccaaactctgccgtccctgaatctctaccctgctttatttttctccttagcagacatcatttctctgtttaatctgtctacttgctaattgtctcactgccctccccctccccactggagagtgaatgaaggcttaaggttttgtctgccttggtctctcctgggtcctgagtaccagtggccttacgtggcatttggtagattacatgcttaatgaaaagtgagtgaatgggctgggtgtggtgggtcacacctgtaatcctggctactcaggaggctgagacaggaggatcgcttgagcccaggaggtcaaggctgcagtagggtatgagcgggccactgcacttcagcctgggcaacagagcgagaccttctgtctaaaaatatttatctatattgagtgaataaatgaatgaatggattattttagtttggcctcaatctttatagaaactcaattcaacaaacatttgagcacctgtttgttcagggccacgtgctggttgcaacctggaaggaaaagctgggcaaggcggagatccagtgctcaggaagctgagtccatgccaagatgtgataattgtataaagaactacaataggcataggtacagatctgtaaaatatgaaaacaggaaaacacatggagtcttggagggtagggaagtcttgatgagtaagattgggtctgagataaacctaaaagagggtcaagattttgacggagggctggaagggaggaacgataggaaactgaccttttttcagatctcttcttgtgcgtggcctggggttaagtgctttacatgcatcccctcattgacttctcagagcagctccataaagagtccctgtgcttcccagtttactctggagacgactgaggctcacagaggttaagccacctacccaggctggcaccgcacactttgttcagagtgggcctggcatacggcatcagttcagcctggccctagacccttttcctcccacaaccatattgcccccagtggagagacaggaaagcagggaagggggcaattgccaagcctgtttctagaatctcaaggatgccatttggtgaagctgaggctggtgcagttactctgtggagacaccagcgtcttggacctagggatggattcagggaggattgtgtcccccagtgacctgctttgtgaaaggtagagaatagattacaggtgcccgagatcctagaacccgtttcttaccatgatggcgttgaggtagaggtagaaagatgggtgaggtggctgggtgcagtgggttgcgcctgtaatcccagcactttgggaggccaaggcgggtggatcacctgaggtcaggagttcgagaccagcttggccatcacagtaaaaccctgtctctgctaaaaatacaaaaattagccaggcatggtggtgtgggcctgtaatcccagctacttgtgaggctgaggcaggagagtcacttgatcccggggggcagaggttgcagtgagccaaaattgcaccactgcactccagcctgggtgacagagtgagactccatctcaaaacataagtaaataaataaaaaataaatataatacagacacaggcttttctccccacctcttttaattcttgaaaggaacagtaacaagctcctattcctgtttccttgccaggagaagtattgttttcatataaatcatttgtgacagaagctccttatttttaagtggaaaatgcacatttaataacatgagaataatgtccaaacatcttctcattgatggctgccaagagaacagcagcactcttgctgcctgcagaaagagacactcagagtcaactgttttaggggccatgctgtcattgctgccgcatttgcttaggtgggctctgagcagcagcttcccagacactccgtaaccaatggcagctgagtgcttttgtgccttgcaaatcctctagtcagagcagacctggcttaggaccccagccctaccactaactgactccatgcgctcctatcggttctttattttacctctgcaagcctcagttttctcatctgtaaagtagggataacattagcttcagccctcacaggcttagagtgaagtttaaataagaaaaggtatctaggctgggcgtggcggctcacgcctgtaatcccagcactgagggaggctgaggctggtggatagcttgagcccaggagttcgagaccagcctgagcagcataacgagacccgtctctgcagaaaatacaaaaattagccaggtgtggtggcatgcatctgcagtcctggctactcagaaggctgaggtgggaggattgcgtgagcccaggagttcaagaccagcctgaacgacgtaaaaagacctatctctacaaaaattagctgggcatggtgtcacgtgcctgtagtcctagctactcgggaggctgaggtgggaggatcgcttgagccccgggaggtagaggcatgatcatgccacttcactgcggcctgagctacagggactctgtctcaaaggaaagaaaacaaacaaacaaaaagccatgtagagctgggctatccaatacttgaaggtagccagtggacacgtggggccatttcaagctaaattaaattttaaataaaattaaagattcaatctctcactcacacattacaagtgctaaacatccggacacatctagtggctcccactgtgggtagcacatacagaaagaacgtttccgtgacagtagagtgtcccattgcacagtttgggtatggagcacttagcccagtgttgggcacagtacctgctgtgatggttaaagcttagttttattggccaggcatggtggctcatgcctgtaatcctagcactttgggaggatgaagtgggaggaaagtttgagcctaggagtttgagaccagcctgggtaacatagtgagaccctctgtctacaaaaaactaaaaaaatttaggccatacttagtggctcacgcctgtaatcccagcactttgggaggccgaggtgggcgcattgcctgaggtcgagagttcgagaccaccctggctaacatggtgaaaccccatctgtaataaaaatgcaaaagatagttgagcgtggtggcgcatgcctgtagtcccagctactttggaggctgaggcaggagaatcacttgaacccgagaggcggagattgcattgagccgagatcatgccacagcctgggcaacagagcaagactgtctcataaataaataaataaataagctggacgtggtggcatgtgcctatggtcccagctacttgggaggctgaggtgggaggatggcttgagcccagaggtagaggctgcagtgagctatgatcttgccactatacatcagtctgggtgacagagcgagactctgtctcaaaaaaccaaaacaaaggtcaattttttttccacattcatctataaaacaataaaggaaacatcctagacacttgaatcagagcccttttaattatgacttcaaaaaacagggctcgtgccacccaagatttcctccatatacaaaaaaaaaaaaaggaaaaagggaagaagcaaaggggcaatacagggctctgcccattagaatctctagggacagaccgaggtttgagagttcctgctcctgatctcaggggaatcctgaattacaggtgttaacctgattatccccagcccagctcttcgttaattacctgaagtgaatgggacagtttccaatactcagcacaaaggcgtgcgcagtgactctgtggcgtactatctatttggccttggaaagttactctctaagtcagggcttcttttcttcaactttggtgtgagactccgctggagagctggttagaaaaacacaagtctcgggccccaccccgcagagcccctcattctctagttctgggttggggcccaggagtctgcttttctagcaagcgcccagatgtcactgatgcttacagctctcagaccacagttggagcagtgatttttaaaagtcttttcatttgtaaagagttgttctccatgctccaaatgactgtgacgactgagaaaatgcatgtatgtaaagtctgcagctggtgacattgtagacactcagcaaatggcctttggtgttactgttattttatttttactaattattttttacacctacaaatcaggatctgctacaatcgcttgatatttgaaaattgggcctaacccactatgccactcttctgtcatgaaataacaatcttctatttaaactagtaaacttaatagtttaaaatacttggtagtttaatagtttaagtagagccactgaaagatggctcacacctttcagctcagtttttttgtaccagtgaggatgaatgtttctgcatgtgggtagttggcaccagtcttcaatgaattatttttcctttagccgggtctggtggtggcgtgtacctgtaatcccagctacacagaaggctgaggcaggaggataccacgagcccaggagttggaggctgcaacgacttacgatcatgccatggcactccagcctgggtgatagagcgagaccctgtctctgaagatacaagaaggccacatgtggtggttcacccctgtaatcccagcagtctgtgagactgaggcagaaggattgcttgagaagtttgagattggcctgggaaatatagcaagatcccaaccctattaaaaaattaaaaatgaaaataaaattttaaagaaaggtatttctccccttcacggtaatttggagccagtacttcttgcaccattcatttgtccacagcatgggacaaaggataatgccttaatgcctgctgcaaatagaacagtggtgcttagcagctttagataatgcattgtaggtgttttgcaaaaacatactttcgtgactaaacatcataagctccaagtgagtgatttccccgcgtaaatgaatgattctgtgaggataacacttctaagatgtgagatttcaataaatgaatctgtaggctgctgtgatggatacctttggtggggtaggaaggatcgtcatttagaacctgggttctgactccagatgacttgttttgttctatcccagaaatattcctaaaatcgatttccagtttccaaaagagcaggtaaggaaaacactgagtgttacttggtctttaaaattttttttaaattcatttttatttttaaaaaatagagacaaggaggtgggcgcggtggctcacacttgtaatcttagcactttgggaggctgaggtgggtggattgcctgagctcaggagggcgggtggattgcctgagctcaggagttggagaccagcctgggcaacaaggcgaaaccccatctctactaaaaacattaaaaaaaaatttaggcgtggtggtgtgtgcctgtaatcccagctactctggaggctgaggcactagtatcacttgaaccggggaggtggaggttgcagtgagccgaggttgtgccactgcactccagcctggctgacagagggagactctatctcaaaaaaaaataataaaaataataaaaaaaaaattacatgaaaaatagagacaaagtctcgctttgttgcctaggctggtcttgaactcctgggttcacgtgatcctcctgcctcggcttcccaaagtgctgggattacaggcacgagctgccacgcctcacctcttgttttcaataccattgataagttgtggtcttcagggacttgtgggcattttcaagttaaatatccaacagtcgtgatttagggcatgaagagctcactcatcaagatgtatgtaattcagattttctgagtgtttaattcggcgtctttggtcacaaggaacagagttttacttgtgccacctcttctaagaaaaaggtttactgtaagagataatgttggcaagctgaggaaaggaggcagttttgggtaactgtctcttgcgatcccctcctgcacaactgtggcgttctctttttctgactagctgattctgctgctgctggatttattcattcttctccctcacagttttggctcgcacatgcttcctttttagctcatggccgtgcagttcaactcaacctcatggcatctttttatcagctgtccctgctgcaacaggcttagagttggtttcccaattccctagcgcagaaatccactggcatgagtcatctttcccattggtagattgcagagcaaacttctggacagatttgcccttggctcatgtatgattggacctgcggtctgtccaggtgtactcagagtggggaaggggagcggtggcaggtaatacaaaacccacctaagtagaaggacctatgaaccatgagggttttccttagcagggagtgccagtgggtagggatgactggttttgcagtttagggccaagtgagttggaatgacagctgtggcgtgttgagtcagatcaagtccagaattcctctccaccccacccatttgcagttccctcagatttattacgggacctggatgtgatgcaagcatgcccgctggctcaggctgtgcctcacagctgcaacatccctggggtggagaagccatgtgggacctcacagaacactccaccgtccctgctaatggctgagaaaggactctgccctcatggatggggttgggggacctgttatcttcttccaggttaatcttggtttcagctgctttaaactctactttttagtgggacgcatcatactgaactatggaagcaccatagttgtcacctagttgagcttctctttgttcccatatgtttcagtgaagcagttatagcttcagaaaagagggagccaggaaatacacttgtaattcatcactccttttatagtcagagcataggaacactcatagtatgtatcagaaactagtgaacacatgttgttttacagctctgtctgcaaaattgcatcgtgggcctctttggggagtgttctcaatgtgatttttattctggggtgtcctttggccacaatcctcaggattattttttctctgtgctgttcactgtaacatcgtccaccctctgagatcttgcttttcagtctactggtatctccacttctctctgcagcgtgatgtctagtcagagtttccattctgtttttatgaccctgggaggactgggagagatctgtgaggtcatcttgtccaccctcagccagggcaggagtattccctaatggtagagtcaagtgtttggtttggtcttgtttctaatgactcaagtgatgaggcctggggacgtcccttgggaagctattctgcagcctaataactttcattctgtgatttttttttgtatgtgtctaatattcagagtctgacacaataaggccataaagagctaagtctgtctatggtagatcttcacctgggaatgttctcctaatagtcacttttgttataaatcttcacctagcatgggagttaagtgcattttaaaactagacctggggactatgtatcctaaaatgcaaaaatagcccccaaaatgaaaattaatgttgagaatctagtcaatctgccagcagtacgtacataactgttctgtgtatatttcacatggccatatatgttttgcttgtgtggtgctaaatgcaaaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgagagcctggtgggaggctgattattgttgagggaaagatctgagagcagggccaagaaagggaaagagagagagaggaaaaaaaacaaaaaagaaaaagaaaaaagagaggtgggtagggagggaggagagacatggacccacggggaatgggaagagaaatagaaatagggaatttgaaatggaaataaaacaaaagggcaggaaaggaagaaataaagagaatgagataaaaggaaaagaaagtgcaagtagatttgggatctatagattggggaaagacattcatacagtcaggaccagatgttcactggaagttttttccttctggatccttctttggctataggaatctggttctcaaagtgtggctcccaggccagcaacaccagcatcactcagaaatctgttagaaggccaggcgcggtggctcaggcctgtaatcccaggactttgggaggccgaggcgggcggatcacgaggtcaggagatccagaccatcctggctaagtcggtgaaaccccgcctctactaaaaatacaaaaaattagccaggcgtggtggcgggcgcctgtagtcccagctagtcgggaggccgaggcaggagaatggtgtcaacccgggaggtggagtttgcagttagcagagatggtgccactgtactccagcctgggggacagagcgagactccctgtcaaaaaaaaaaaagaaatctgttagaaatgcatattttctgttttcaccccagaaatcctgaataagaaacactaaaggggagtgggcccagctatttgtgtttttggaggaactcctgttttaatttgttttttcggaagtcctccagtttgagaaccaatgataaggacatttttccgggaatccagttgttttaggaaaggcccagtaggcatttatgtttataagcaactccaccctgcactccatatgccttctgtagctatctaacagagacagagttgacttgcagaaactgttttctctggccaggagacaggcttcgttttcgaaactcacccaggaaggcagtgttcttcttttcaaaaggcatttttctgttgactgtgcatgaagccacatagtaataaacagtttccatatccaagcagctaaggcttgtgccttgcaagttaagtggaacatcacgatctatatctcagttttccttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctctgttcatgatataacagtaaatccaagttgctttaagtagatattggaaatatgaacccaatatgttcttaacatctccatgtcgtaattctaatttaaaatcaaaatctcatcaaattacattttagattaaagcattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttctcagggcgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattagatctaacttgcttcatttttaggcattatgttattctaaattaacactgtatttcatattctccaggtctgactattaaccagattttggaacctttagggcttattatttagtaatccctgaagctctcaagtaggcgtttttaaattcatgcattagaacagattaaaaattagctagaaacgcatgttaaatggcccactccctttcttttgctaattgtgctagaaatgaaaaagaaaatgcaagtgaggtcagatctagtgtggtacaaatgaacttgctacttggtttgctgccaattgctgccgaaacaggagttatttaaattagtaaataatttttgaaatcttcttagaatgtcacaggccacaattcaaattcacagaccaggaatggttattatttctatatatcttaaagttttctgcaatagaaatgcatttcaaatataagctagaaaaaaaaaatgtgaggccttattgtgtagataaaagtgacaagatgtccaaatgttttgaaacgcagtgatttatttaagttgtagaaagcttggttttatttcttgttgcatcgtctttatccttagatcttaatcagaaataggaaaattttctgagagaaaattcacgagatcattcatgatgagtcactatatcagttactttaaaaaaaaaaaaaaagatcctgacaaatcctactttttcaggtcctgatgcactaagtctcattcacttctttctatttttcctctctctattgcatattaacccaccatattgagagaatagaaacttttgccttcattatatcacctttacaccccaggacaggtgccctcctcagcggagacaactgtccccctccatcctgcaggagttttgcagccatccttccagccactgcttctctaccggggcaaattttcccccaagggataattgataatgtctgaggcatttttaattgtcacaacttggggaaggggcaagggattgagggagagtgctcctggcatctggtgggtaggggttagtgatagggttcggctgtgtccccacccaaatctcatcttgagttgtagttctcataatccccacgtgtcatgggagggacccagtgggaggtgattgaatcatgtgtgcagttacccccatgatgttttcatggtagggagtgagttctcacaagatttgatggttttatacgatgcttttcctcctttgcttggcacctctccttcctgctgccgtttgaagaaagacatgtttgctttcccttccaccatgattgtaagtttcctgagacctccacagccatgccaaattgtgagtcagttaaatctctttgctgtataaattacccaggcttgcatatgtctttattagtggcatgagaacagactaatacagtcagggatgctgcagaacatctccaaacacacaggactcccaccctctacttccaccccaccaacaaagaatgattcagcccaaaatggcagtagtgaccttgttgagaaatgctgttcaagccatacgtcaccattggaaggttgccaaactgtgctttgcacacacatgctgtctgcacgccttgtatttttctctttgcttagtcctgctcatgctctctaaacaccccagacatcatatctctttaagaaactctggctgagtcccataatgttctggggcaacttctgtcttcccttttccctctggcaaagaatccttgaccaaactttagctcagctcctcagagcccacttctcaactagaccttgaccttgctcctctctccttgctggatcttcatagtccagtctttgtaagagtcattctaagtcagtctagagagaatcccttcacccttcatgtctgatcacccttgcctgccttcagcaaaaatcctgctaacttggttaagttggaatactcctacccttgtggttccttgtagtaatttgcatccactgaccctcccactcccctgctactctgttccttgactataaatctccagctgtctttattatatttggagttgagccctatctctctcccctattgcaacagccttgacccctgttgaaataatcctgcataaagtcttccttaccattttaacaaatgtcaaggtaactttgttttttgttttttttgtgtgtttttttggagacagggtctcactctgttgcccaggctgcagtgcagtgatgcaatcttggctcactgcaacctctgcctcgcaggctcaaatgattctcctacctcagcctcctgagtagctgggattacaggtgcccgcccccatgcccagccaatttttgtatttttagtagagatgcggtttcaccatgttgaccaggctggtctcgatctcctgacctcaggtgatccatccattttgggctcccaaagtgctgggattacaggtgtgagccaccgagcccggccaggataactttttaacaaccccccctccacactgccaactttttgaggaccatgtgttgtgtagggccggatatagtgcacatggtgaacacataaataatgtttgttggccaggcgtggtggctcatgcctgtaaccccagcactctggaaggctgagtcagaacgattgcttgagctgaattgttcaagactgccctgggcagcacagtgagaccccgtatctacaaaaaataaacaaacttagccaggtgcggaggcattcacctgtattcctagctactcaggaagctgagatgggaggattgcttgggccctggacgtcaaggctgcagtgggccatgatcgtgacactgtactgcagcctgggcgacagaatgagaccctgtctgaaaattaaaaaaagaagaagaaatgtttattgaatgaagacatgaaagcatttggtggaaatagggcacacacatgaatatattcacagttgcaaactcagaaggatactcccaacctggttctttgtcttgtccctccatctgggtgctttccagtcacagcctggatgcatgtatgaataaacttctaccattaagtccctgaattatttaagcactgccagtgattctatataaaccgttcagtaaaatgaatggcatatgcgtatgtttcaagagctccagcagcctacccaggatggcttgatgttgtctcttagcaccgtatcaatacctgggggttttcaaatattgcaggtggccgaagcctttgtgttgaggtttctgtagtgtttatccatttgtgaaaccaggcctcaatctatatgtccaacgccattcgtagaccccctttgataatctccactaagcagacatactcgatacatcttcactaatgagttctgacttcataaaatgtattaatgacttctttttgaaagtaagagtgctttgaataccagtcgttattgctttagaagttcataaaagcaaaagcacagtatttcccccagtgtttgtgcgataagagaatagatgtaggtccagcgcctagaattttagctatgcttctcttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggctgggcatggtggttcacacctgtaatctccacactttgggaggctgaagtaggctgaagtgggaggatggttagagcctaggagttcgagaccagtctgggcaacaacgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataataaagcactgtctctctctacccttgcagtatccctgtaggagagagttactattagctcccagtttataggtgagtgatatggtttggatgtgtccccacccaaatctcaacttgaattgtatctgccagaattcccacatgttgtgggagggacccagggggaggtaattgaatcatggggcccagcctttcccatgctattctcataatagtgaataagtctcatgagatctgatgggtgtatcaggagtttccgcttttgcttcttcctcattttctcttgccactgccatgtaagaagtgccttttgcctaccaccatgtttctgaggcctccccagccatgtggaactgtaagtccagttaaacctctttttcttcccagtctcaggtatgtctttatcagcagcgtgaaaacggactaatacagtgaggaaatccatgtgttaggaagggagtgtggttgtacttcaacctggaactgtctaactcctaaggttttattaatatctagtccatttctctcaatctaatagtaaatggaagagaagcaacaacttttgttttccaattccttttgaacatttgaaaggttttctgaaaggacttaaagaaaccatagcttccttaccagttcccaaagcttcagtccttaccaaagtgtacattgcctttaaggagatttgtttccatcaatccctcccatttacaaggaattacagaagagtgatgcccccttcaaagtggctcacacctggctgacatctgttcattaagaatgcctgcctttgggttctaagacgtccaaggagctcttatgggtaacacctgtagatttatagacgttcctctctgactgtaagggccatatgcctgaatctctcacccccatgtttataaaacttaacaattgtggaagcaatgaattgaaggactagggtcaccagtggagtcccataaataggttgtttatgatccctgtgaaacaagaagaccctcttaatttcatgcttcttaaactggggtatgagtggccccaggtttccctgttgggggtactgataccagagttcatttgaagtcattggaaaccaaggcatattttcttaaagagacaactgtttttggtgaataggccatgttgtttatagtaaaaacaaacatgaatattctgtaatagaagatatcgtttgcatggtgttttaaagctaaaacttgagttattaaacacccttctctccctggggatgccttttgctatggggttgcatccacggaagagtttgaaagcccaaccatatggacatcatattattcatttttatttgccatccagagcttgccagcaaccttttagatctctttccttggaaggttcagcaagatgcttgtaaatgtatgttgctttgttgcagacaatgtatatttaaaaagcaattatttgcccatctcttgttcaactcagatattgactgcctttctgtatttctggctgggcattgtttatctccacctcatggtttttactatggttctagaggtctagcctacaaagagaatgcttcccgtccccaccactacccacaggaccctctgcatatctcagaggaatttctcagtgttccagttaattttctctctgtttcctttattacttctaagttccattgcaaaaatatgctgcctgctctgtcagccaccctatatgcctatttagtcccagttttccagcttctatttttttccacataatccctaaccatgataatacaaatataatagaaataattatgtttgtttaaaatatacacagaaccaaatagtcatagagtagtatttcaggtggggggccctcctctagggcagtggagacaatgtcacctgtcgggaacatttggcaatgtctggagacattgttggttgtggtgcggtgacataactattggcatcgagtggatggagggcaggtgtgctactaatcgccctctattgcacagggtggcccttaccacagagaactatgcagctctaaacatgcgcagccccaaggctgagaattgttgatctaggggaagatgtgatttcattcttcatgcttgtaaattattatttaagctgtgaataccctctcttttcccactgaagttgtggttgtaagattctcagagttaagcagactcggcaacattacagaaaaaaaatcaagatgtaaaaaggatttagacgtctggacgtggtggctcatacctgtaatcccagcactttaggaggccgaggcaggtggatcggttgaggtcagagttcaagaccagcctggccaacatggtgaaaccctgtttctactaaaaatataaaaattacctaggcgtggtagtgtgtgcatataatcccagctactctgtaggctgaggcaggaggcagaggttgcggtgagctgagatcgcactacttcattccagcctgggcaacagagagaaactgtgtctcaaaaaataaaataaaataaaatggatttagaaatggtacagtcagaggttaggggtcgggtcaaagcgatccccccagagacctgtggaaagtgtggttctgtctacaagctgcgaccatggtctttactgcttctgcaaatacttgacaaaaagggccacactcttagctggacttttcctccctttcctgaaacaatgcccttcccattgtcaaggcagaagcagcctccactgagaagcgtcagacaccacgtcagtcttgctttccattgctttgctccagtatccatttgaaattcagtgcaaacccataaattccactttgcctctggtagcagcctgcatggtgtgtatattgaacactagaaacacagtaaatccagcccatttattcacattaaccagcaaaggcattctgcatgcccatgtaaatactggaaattactgacatggccttctagaccatgaaaagacagaagcatatggcagaattcatatgtgaacagattgctttttctcataagaacgctttattggaatatcaactattacagctttttgaagttactcttcctgctcttgatttaagtcctgaatcaccccactactctttttttttttccgctgcattctgctatgtatctttacatctgcttcctgcactttctaaatggcctacttaaaccttgaggtaggtccttcagtttcccataaattaataacacatctatgaatatttcccagccagtcttagaagccccagtctattccaataccaggattgtaaacacagggaatagatgaagcaagctgcttctttcaaatgctcttccaatatgaagcaaaatattattgatctagactgcctgctactttcatttaccatgttactactcgtgggattacaggcacaaaggtttcataaatttcaaatgaaatatgaacatttgttgtcaaagtactgttaaggtatgaaaaccctgctagtattagttcccttttgttattattctattattattattattattgtgtttacatccacaggcaatcacatattttaggttgtggggagcaaagcagcttccccccactttttctctcactccaatttgaatcctcccatatgtccctccctcattttttaagcaggaaacaatgaatgagtttttgctcctcttgccctatttgccgtgtctcttttctgtgattcgggagcacattgatacccttcttttggagcagagaagcttgtctttcatgatagaagtaggtcatgggggcggttagctgacttcatcagagagtagcatgcagatcccacctgtgaggctatggtctgccaaggagagttcagcgggctggatcagagagagcagagccatgctggcaagtcggagtctttgtggaaagcagccaaggtcacagctggaaataaaactgtgtattccaaatcagaggggcaatgcaggaatggatcaaaggaatgaaggatcaagttgtcagccaagagaaccaagagccagacacagggaacctgtgacaaaaacgaaaaccaataaaaacatatattgagcattgaccaggtgcccaatattttaatgtcccatgggtgtgcatcaggtacgctgtggaaggacagatgtcattccttaaaggggctgcactgaattagaccaggggttctcaaagtggggtccctggaccggcagcatcaccatcacctggaaacttgttagagatgcagatcttgggccccgccccagacctcctgaatgtgaatctctggtggggagggagacgaagtgggagcctgtaggctgcagtctgtgttaagctttctgggtgattctgatacacggtcaagtttgagatgtagcaggagaagcaggaaacataggagagaagccactaggggtgggaatcagaaatacggtgtccctgcctacctaggggctacattcctccgggcaagtctttttaactctctctgcctggcaacttccttaacaaagagtgatactaatacctgccttcctgtctttgccacatcacgggattttctacagctcatattggttacagtgatagcagctgagatttaggctgcacctgagtaccaggcagggtcctaagtgacttcagactctatagacagtccctgacttataatggtttgacttagattttttcacctttgggatgctgagaaaaccatacacatccagtagaaaccgaactttacattttgagtttcgatttttttttttcacctgggctagtaatacgtggtaggatactctctcacaatgctaggccacagcagcgagctgcagctcccagtgatcacaagggcaaagaatcgatattctaccaggcacggtgttgcctgataaccttgcccagctgtaggctaatgtaagtgttcttttttatattttctttaatttttttaaatttccacctgttttggggggggtacaggtggtatttggttacatgagtaagttctttactggtgattggcgagactttggtgcacccatcactcgagcagtatacactgcatccagtttgtactcctttatgcctcacccttttaccactctttccctctcagtccccaaagtccattgtatcattcttatgcctttacatcctcatagcttagctcccacttataagtgaaaacacacagtgcttggttttccattcctgagttacttcacttagaataatggtctccagtcccatccaggttgctgaaaatgccatcagttcattccttttcatggctgagtagtattccattgtatatttataccgtagtttctttatccacttgttggtagatggccatttgggctaatttcacatttttgcaattgtgaattgttgtgctgtaaacatgcgtgtgcaagtatgtctttcatataaggacttcttttcctctgggaagatacccattagtgggattgctggatcaaatggtagttctacttttagttcttcaagaactctccacactgttttccatagtggttgtactagtttacattcccaccagcagtgtagaagtgttccctgctcaccgcattcacgccaatatctattattttttgcatttttggtaatggccattcttgcaggagtaagatggtatcgcaaatgcaacaaaaacaaataggtgggacttaattaaactaatcagcttttgcccagcaaaaggaacagtcagcagagtaaacagacaacccgcagagtgggagaaaatctatacaaatctatacgtctatacaaggactaatatccaggatctacatggaactcaaattagcaagaaaaaagctaacaatcccatcaaaaagtgggctaaggacatgaatagacagttctcaaaagaagatacacaaatgaccaccatacgtgaaaaaatgctcaacatcactaatgatcagggaaaggctaatttaagtgttctgaacacatttaaggtaggctcggctaagctatcatgttgagtaggttaggtgtgttaaatgcattttcatcttatggtattttcaactcggtatagggtttaatcccatcctaagttgaggagcatctgtatctgttttggtcctgacaataccccatgaaggaggtgcaattacccctggcttagggttgagaaaactaagaggtttagtaatgtgcttgaggccatgctacctgtaagcaagaatcactccaggtttttcttgtttcaaaactcctgttaacaactgagttgctatactgttttagtaggtcaagatatactatgtgtttcaaagggcttataaattataaatgctacttaaaatgatgtaaagtggtattattgttgtcatcatgtatatattttcaactctctcattggcatcttgaggtttctcttctatgaaattctttgccctaggatggtcccctttgtcaaagagagacacattctgaacaaggtcagacaacacagatggagtttggattcgggcactggtgacagtgaagactcagatgaggttcttgagtactttcaattaggtttaccactgaccccatcagtgtgcagacgaagggagatgagagatacagatggttaatgggatttttggggtatcttccagcctttgtgagcacagaggtttcgctacattttgaaaattaaaattcatttcattcgcattacagattttaaatcctagctcctttttaagcttttaattccaacttgcatttcttattattctgtttacaaacctgacaaattttagcagtcgttttgaggagatctagaataatgtttcatctcatttttgaatttaggtacagaccttaaaaatattatgctacatttctaatattaatatcttgctttcttatttaggaacttttcctgacaaacttcccaagaatgtaattttgttatatccatatgataaaccttaagtattcttaagccaggtgcagtggaattcccctgtagtcccatctactaaggagactgaggcaggaggattgcttgaggcctggagatcaaggctgcaatgagctatgactatacctgtgactagccactgcactccagctgggcaacatggtgagaccctgtctctaaaaacaaacaaaccttaagttttcttaatgttctgacacttttataaatgtagtatttcaacttatggtcaccattctgtaatgattatcatttgtacatttaaaatagaaactgttaggccaatgtgttattctagaataggacttgacagacttttttttaaataaaatgccagatagtgtttctagctttgcagttcagatggtgtgtgttacaactgttcagctctaactttgtatgaaagtagccataggcaatacacaaatcaatgcaccatctgtgttccagtaaaactttatttataaaaacaggtcacgggccacatttggcccatcagccatagtttcccaacctctgctttggaaggcctaactcagttaaacattacaagttcatgcagcacggtgtgatggctcacgcctgtgatcctagcacttttggaggcttatgtgggtggatcgcttgagctgaggagtttgagactgggcaacatggtgaagccgtgtttctacaaaaaatacaaaaaaaaaaaaaaattagccaggcgtggtagcttgtgactgtactcccagctacttgggaggctgaagtgggaagatatcctgagcccaggaggcagaggttgcagtgagctgagatcgtgccactgtactcccacatgggtgacagagtgagaccctgtctcaagaaaccgaaaaacgaaagaaaaacaagttcatgagataccacatacgtgaatatatgctaacacagcagcattattttttggttaatcaatgattatcaatgcttctgtgattttaaaaaggagagtcagctattccctcttctgcccgctgatatctacagcctctaccagatggtacctcacttaattgaggtttgccttttttcaggctcttctaatgatcttctggccaactctaaatcacctttaaacttcatggaatttatgcattcttgttaatttatatccatgtaatatcagggtatttctctttgtagctgcatcttctaagataatggtttttcatggagactggcattgtcccgtccctatgagggggacatttgggaatggcatttttagtactcacaaggtaactggggcactcttggtcttggggaggggaggtggctggggacgcagagggtcctgcggtgggtggatacttacaacatagaaatgtcctggctcttgatgctggctacaccctcagtaagagatactgtcctagggtcatttttttcaacccacactagttacgtggactgtcttagtcagtccaggctgctataacagaataccgttgactgggtggcttgatttttttttttttctcccagttctggaggctggaagtcagatgtcagggcaccagcatggttggtttctggtgagtgctcttttctgcatttgtggacagctgccttcttgctgtgtcctcacttagtagacagagagagagagagagagagagagagagagagagagagagagagagagaccatctctcttgtgtgtctttcattcatgagaactccacctttgtgaccttattacttctgagaggccctacctccaaacaccatcttattgggtgttctagtttaacatatgcatttggaagagagaggaacatattcagtccatagcatgaaccaaccacgtgcacagaggtgtgccccaatttactgtcagtgcagccttcacaggcaggaaacccaccaggtccaaggaaggggcactcagctgttacctcctgtcataggaccattcctcactgtgccatcatattatacttccatatcgtgtgtcttgtggcattcctgggcctgcagtgagcctgtggccacctcatagtcttgttggccacagcctctagaaccagggattggaggaacagccatcgctagcatggtgcttggcactgagcgggtgcttagtgaatatttattgaatgatttccaactaatggaagaaagctgaatagcacaacacccagaggattgaggtttattgaaaaccaacccaaagggctatggtgaaaatcatctcaaaaggcagagggcaagaaattgatatttattgagggctctcagtgggtgttgtagggggaaggaagtacaatgtcctggagctaggctgcctaggtttgaatccagggtctgccagatgtagatgtgtgatcttgggcacgtttttcaacctctctgtgcttaatcttctcctctttaaaggtgggctagtgatagttacctcacaaggtagctgtgagaatgaaataatgatacataaagcacttataacaggacctggcatgcagtgagtatcagtgggtatttgctgtggttatttagttatctactttacatgtacatgtaaagaactagggatatctgtattaagacagggtcttgttatgtttcctgggctgatctcaaactcctaagcttaagtgatcctcttgccttggcctcccatagtgctggcgtttcaggcttgagtcactgttcctggcctacttaccttctttttgatcttctgaagtcaccccctccatctgacaggaggttgaaggtccgatggccacataggtggcagtgctggaatttgaacccaggccttcctcccttacctctctctacctctatctcttctatctacctgtctctactccctctccctacttttctctttttcccagcctccccccgatatactcaacatatatctccctctccctccacccacctgcctcccccacactccttctttccctctcctctgcagggagagcttggaaaccaagagtctatgagctcgaagggagcatgcaaaggtgccaggcaggccctcaaagctgggaagctgcagtaggggttctttgggacccagttaagcagtgggcccttgctctgagatgcagtctgctgagctgccatctggggacacatcttgagtttctctccatgatggcgcagctctcagcgtaaagcagtctatggagtgagaagggaaaaggccccagtaataaaaggcaaaggaagcctggtgaagtgactcatacctgtaatcccagaacactgggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcagtgagcagtgatgactccactatactccagcctgggtgacagagtgagactttgtctcaaaaataaaatataaaataaaataaaaaggaagaaatagccagtagtgctttcttgtagacagagaagctggtgaaatgatgtaaccaggctgggcatggtagctcacgcctgtaattcccagtactttgtgaggctgaggtgggcagatcccatgaggtcaggagtttgagaccagcctggccaacatgataaaaccccatctctactaaaaatacaaaaattagccaggcacagtggctcatgtctgtaatcccaaatgcttgctcgggaggctgaggcaggagaatcacttgaatctgggaggtggaggttgtagtgagctgagattgcaccactgtacttcagcctgggcaacagagcaagactctgtctcaaaaaaaagaacaaaaaaaaaaaaagaaatgatgtaactggtagggagaaagccaaaggttagaaagagaacatgaattgagaatggaaagatcgcagaggaagcagatttgtctgcacacctcttgcatgtgtatttggagaagctctgtgtgctgcgggtcgagggaaacacataactggaacaactgtccttttccaccattgttaaatcctgctttgctcactgcaggagagggggattatataggagcttctggaaacagatgccttgggagctctcctccttttccagaactcccacacttgctcttgtagatcatcataggataactctccgctccctttcctaagaaaattgatctaaaaagtaattatggaatcttgcagtgcttgttgggatcagagaaggctcctccgatgatgggatgttaggtagagggctgcagggaccttgcttttagtcaggaggcaaatcaagagccaagagagggaggggtggtcgtgagtttttatgatgttccttctcttctccgctccttcctgacaagagtctgtctcttttctctgtgtgtcataactacccacattcaccccggcagcccatctaccttgtttctctcataagtcagcttctctcccatctttcctgtgaaaatttctaacaaaatgggagttaaggccgggcatggtggctcctacttgtcattccagcattttgggaggctgaggtgggaggattgcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtgagccctggtctcaccactacacttcatcctgggcaacagagtgagatgctgttttgtttttgtttttttttgtttgtttgtttggttttttttggaaaaagaaagaatcaccataaaaaagatgggtaactcggaaatttcaaatgcttgaatttcttgggttgggaagaatatcccaaaatgtgtttccaactacctcactgattttgacttcacagggagaatattttgatttttatgctctgagttgctggtactgctgtgggcacagaactgggtatgacagaacatttttctgaactatgactctgatcttctcaatctctcagtgggaaagagttttggaacttattatttttaaaaacttggtaaaagatttataccataatatttatcattttaaccatttctcagtgcacaattcagtggcataaaagggcattcctgttgtgcaaccatcacccctatccatctccaagtgaacttgattcttaaatctcccagccatctgtttcaattcactagatgttgttccacccagcacgtcatggtggaaaggggcaggctgtgattttttttttttttaacctccagcagctgtgttccctgtggcaactatgtaacctctctgagcctcaacatctgtctataaaatggaaacagtgcaacctaccttagcatttgatgatctcaacttggatcccatagcgggtatctccaaaatttcctcatcttgactacgttctggtgaaacttaagatgtcagcacatgacctacctcccttcccttctcattcatctgcattttcacaatgcttggttttatcttttatacatataatgcacaatacatgtagtgccaacaagaattatagtttctgtaagtagtgtatgattgcccacggatcttcagtaactcattaggcactgacgggctgacatgagcaacaacgagacttagtatctgttgcagctctccatacagtttacgaaactctaatccataaaagccgtttgaaatttccattaggagatttgcacaagtggttaaaattagtcatgcattcttggtctaaactgcaggaagggtatctttactgtgaaaatgattatgacatgttaaaactgtgtaatagtaagcagacagttttccgagctgctgggtgaattctggaaatgctctattattttctccctgttgactcctttctttcaggcaagacagccagcatgttgacttggaaaacaactgaggctgagcagtttcagagcattgacattacgtggcttcttttgtgggccaccccaactcttttattttttttaattgctgcttcttcctctaaaatacaacttgttttttttttttttaaagaggaggaagccttaaaaaccagcgacagtcttggttttcttaacctgtccgccatttaacatttctagaagtgcaacattgcttctaaggtaagggcaaggaccatgacttttgcatgctgaaaatgagctgcctggtttattgagttagttattcctttttagtgccgcagtgttttcagtgttagagaaaaggctgtgattttctttgatattaaaaagccaaccacttatattttccaaagccatttgcattcagtctgacggccgctaaaaatgtatgtggatttttcatctgagaggttttctctatgcatattgtttacatttatcaaatgttgtcctgcccagtactttatattcattgttgcttccggacctagctgacaacatggtctatatgaaaaacaacacaaaacaacacataagagagtcaaagggacttctttggggagaatataaaaacaagccaaggcgaaagtggctgtaaaaatgcgttgtgttcccaagtggaggctccttctttgttctgtcatcagtttgtcagttgtcaatcaaacctcccttcgcctcacacgtttgctaatgtaagaagtgctggctctgctcttagcctgcagtggtgcagcttaaaaattctgggagggtttcatgcagtaaatacttaaagtaacagaaaaggactggggaaaagctgatgttgtagctgtatgatcacccatgtaaaactgtttatttagttatttatttatttatttgcttttttacttccttttctatgcctttggtgactttgtgtaatgctgtatgtaccatcagagcacatactgcttttgtgcacacatacattgaaaacaaaatgaaaaaacaagaataaaacaaaaaccctattcctattcctacaattctggtactttgccacaaggtggtggtagtgtatcttgagtaaggaatatgacctgctagatataagcatctgtttatttacacactaaggaatgtttgagtgtggaacgtggtttagatgctgtgcgtacagcagtgactcagataggtgtgtattctcaagaagctttcattctaatgacacatactttgtctccagtcagagttatggcaggtttttttttttttttttttttgactaaattcacccatatttgatggcaagtgtgatcacagcatgtttataaaaatcattcttaattaaggcatttccatcttatcaagccccctatttaataaggatatcaaaaaagaaaacagttttcgtgcatatgtgtagctttttagattcactttttccttatttgacccatataaactttgtctgtctgtgtctgtcagtctcacacacatccttcaacacatctcttatttctttccagagccaggctaaagcacccttgccatcttctctctctgctgttaaattagatgccttctccaggaatctctctgggggcatcctgagccttcccgattccatttcagatttctttctgtaatcaagagctccatctctgttgctttcctggggctcttcctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggaaaggctctttcagctgctctttctcgatccttgcagtttcccttttgacctgtgggtacacatggtactgacgcaattggcacctcagatggttcttcctgacagctacccttgcaactgactcaggatacaaactacctttttttttggagacagatctcactttatcacccagtctggagtgtaattgacgcaatcctggctggctgcagccttgaccttctgggcccaagcagtgttcccgcctcggcctcccaaagtattaggattacaggcatcagccgtcatgcctggcacaaactgcctttggaagtgaatcagtcagttgcctagtaggcctaaggagaccatgatccatgtaaaccatggaatattttaagcagaaaagaacgtattccccttcaaggacaaagtgctggaataattgacatccaggttatcacagagccttcctatagtgttgattctgatcactcaaataatcttagtgttaaagggtttatttttatttttctaccttcttttaccaccccttactcccatcagagcaccatcagtcttttgggaataaaataattcctcagatatattaaaaagctatagaagcagaagttaacgtacatgcaaaaatctctacatttctcaacaattgtgtaaccactaaatatagggaaagaagtgtgcaaggtataagacattggccatgcgtccttgtctgtgccacctcaccaggagcattgctcctttttatgcacaagcatcagaggttctggacatcttcttgggctagttggtatagcttccttctcagctcattctgcaaggtttgctttggaaaagtctgtgcatctgagctctctcttgccatatcaggaaccgaagtcagaaataaaggctacagatgctcaaaatctgcagtattcaatctttttaaggcccagcatggtgtctcatgcctgtaatcccagggctttgggagactaaggcgggtggatcacttgaggtcaggcattcaggactagcctggccaacatggtgaaaccccatctctactaaaaatacaaaaattagcctggtgtggtggtgcacacctgtagtcccagctagttgggaggctgaggcaggagaactgcactctagcctgtgctagagagcgagactctgtctcaaaaatataaataaataaataaataaataaataaataaataaataaataaataaagtatctgtccccaagtcacaatgctattcggttggtgcaaaagcaatcgtggtttttgccattacttttaatggaatagtaaataacacttgatctttggtcttctgacctgaaatcccatggctaggattgtcagatagaatacaggacacctggcctgttacagtggctcacacttataatcccagcaccttgggaggcagaggcaggaatatcacctgagcccaggaatttgaggctgcagtgagctatgactgcaccattgcattccagccagagtggtagagcaagaccctgtgtcttaaaacaacaaaaacaaaaacaggacacctggttaaatgtgaatttcaggtaaataacatattttttaaaaatgtatcccatgcagtatttggagcatatactctaaaaattttctttgggatatacttctaagaaatgatttgttgtttatgtgaaactcaaattttactcggcatcctgtgtttttatttgctagacgtagcacctacctgtgacatctttttgtttctgccctgctgtgtcacagggtcttggtatctttcctcctgtgattctgacactaccttgggaaatgactctgtatcaagcgtttaccatctgctgaaagctttgcatactctgttgcttatcatgacaactgccctgaaagttgggtgtacttgttacccctttccagattaaaaaacctaggggtcagagaggttaagtaacttgctcaagacctcacagtgaactgtggtggaccactgggattagaacccagtgagttcagtggctttgcctccaagtgcgtttattattgtccgcactccaaaatggctttaaaaaattaaaaagatacatgacgttgaaatcagtgacagaggcataaggctccttgagggaagaaaccaggtgttggccataaaaaaattatttttcacagcgcccagcaaagggcttgtatgcaaaggaccctcagtataagctggttgttgactgatgtgtttcaagagtaagtcagaaaaataaaaagaaggcagggaaagagttcaaaactcagtgtcacttgcacatccattttgccctagaagtgttttaaattttatcaggctcataaactatgtttcgaaacgtgaaaataaattggccccctgaccccttatgaagtgacatcattcatctgaaaggtttatcgccctgcgtgtcattttgaagttccctactctcctcctcgttctctaaatccatgaaaaaatagaaatgggaggaagaactggagagaggggttctgtgtgtgtggaatgtggctctggaaagcccccagccctcctgttaacacaatgcttttatcccgtaatctctgcctgcgggagacaaaataacagttcatctggaaaacaagattaactcatttaacttacgtagtgatcacagagagaagcttgttggagttgtctggctgaaggaaagcccgcgattctcggccattccggttcacagggcctgggtagcgggcccagcctgttgcaagtaatcgggctctgtcagatcagccttggtgagattgggatattaccagggtattctgttcatctctgacacaggccctctcaatctgatagacggtgtgcctcttctcttcattagaacatcttcctgaacacttgcctgtctgcactgccctgctaaggggttttcaggtgagcgtgctgtgggtaccttcacatttcaggccttttaacagggaatgaaaaccaactgccctgtgattccaagtctgctgatgcatgtgaaattggctttgtgttggggcctcttcttccaaagcaacagtaagcattttttttttttttgtgataatctctctctgtcacccacgctggagtgcagtggtgtgatctcagctcactgcaacctccgtcttctgggttcaagtgattctcctgcctgagcctcccgagtaactgggattacaggcacccgccacccgacgcccagctaatttttgtatttttggtagagatggggtttcaccatgttgcccaggatggtcttgaacccctgatctcaggtgttccaccctccttgtcctcccaaagtgttgggattacaggcgtcagccaccgcccccggccgatagttgcctttcttaccagcctgggccaggagcagttgtttattttctgctatttcgtgtgtttctttttgctggcagtgacatactcctacagggatgtctgcctcatgttgacctgcttgtgtttaccacctagaggcctaagaacaggctttccccgttcaaatcacccagtggcgtgcacacttggggcacctggggactggtttcctgaatggcattgagagtcattactttccacacacagttaactgcagggagatttgtctctgaaagtagtcttcaagaaatgcggcagctgcttctagccgctccatccttccttttcccagtgcgcactaaccctccagagccttccgcatctgctatgcagcattggccacaccagtgggatgcaagaatttatcccttctgttgatgcaattaaagctaatggatctcatatatatatatatatatatatatatttatataaatatattttatatttaaaaatatttatattttatatatttttatatatttatgcaagtatatatctaaatatataaaatatatataaatatatacatatatgtgtatatatagattttgttttttgagacagggtcttgctctgtcactcaggctggagtgcagtggcgtgatcatggctcactgtagcctcaacctcctgggctcaactgattctctcatcttagcctcctgagtggctgggaccgcaggttcatgctaccgtgcccagctaattgtttaattttttgtagagataggatctctccctttgtggcccaggctgatctcaaactcctgagctcaagcgatcctactcactcggcctcccaaagtgctgggattacaggtgtgagccaccatgccaaagcctaagggaccttagaattttttctcctttcttttcacattttgttttgtgcttgcttatttattgaaatctggaccacaaataacttacatgtttgtcaaggccagatttcaggacctaaccaacacccgacaggcatcttagaaagtggagggtgtaagttataaagagagattacttccaacacgtttctttaaagcctgctggctaaattaggtgggaccttctttgtgtcctctctgttcttgctagtctggcctttgtataatagggaagcagatatatctggaagcctctaagtgtgcatcatggaaattgtttgaaatgttcaaagtgatgtggatgtatatatacgttaaaaaatatcactttcccttttgaagacatttactatttctatggtttgtttagcaacagcctggctgaatagttcttcaaaaaataggaacatgatgctcatatctggccactgtatatgctttggagggaacttgaagactaggtggctgcagccactcagaatcttgttgaatatttaacatttttttgtgaatgtatcaactaagaagactatcaattttagagcatacagctgttctagaataatagtttgaaaggccagccgcaaagattgtggtgattaaagtgtgagcagatgacggaatgataaaccttaacgcttaaaaatgtgtttttatagtgccattcctatataacatcgtctgataaatgtatttgagacgaacaggccaaatgaaagaaccttccataaggggacgcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaagctctcttggaaaaggaaagagcatctctttcaggagcttccctcttggacattaaatcttccataatctgtgctagttcggcaaagaagccccaacgtcctcccaatcatagggcgcctgagctcttggtctcctatatcttatattcattatagatgtcttatatccattcctgtatcctttgtgatgtcttgagtgagaaaatgctctgaccaataagccaatgttcaattgacttcgaaatgttatgtgggataggctcattcagggtggtacggctgtagacaaaatgctatatgcattggctgggcgcggtggctcacacctgtaatcccagcactttgggaggccgaggtgggcagatcatgaggtcaagagatcgaaaccatcctggccaacctggtgaaactctgtctctactaaaaatacaaaaattagctgggcatagtgttgtgtgcctgtaggcctagttacttgggaggctgaggcgggagaatcgcttgaacccaggaggcggaggttgcagtcagccgagattataccactgcactccagcctggtgacagagtgagactccatcttaaaaaaaaaaaaaagtcttatattgattaaaagagacttaagacacatagtaccagatggattgtgtgatgctcattttgatttggatttaggggaacctgctctcaaagacatttttctgagacaaataggaaaatttgaatatggagtagctaatagatagtattaagagagtagccttcattttttaaagtataataatattttaattgagtttatgttagagatgcataccgaaaaatctacaagtgaaatgatatgataactaagacttgctttaaaataatgcggaaaaaactgttagagtaatagcgtaaataattcaagattggaaaatgttcatgttaaattattgttggccgactgtgggttcatttaattaggttctctgttttggggtatgttgaaaatttttcataagaaaatattattcagaggtctcaagaggcaggctgccaagaatagcagttagaaatagctagtatcaggcctggtgtagtggctcatgcctgtaatcccagtgctttgacaggctgagggaggagaactgcttgagcccaggagatcgagaccagccagggtaacatagggagaccctcatctctacaccgaatttaaaaacttagctgggcatggtggtgcctacctgtggtcccagctgcttgggaggttgaggcaggaggattgcctgagcctggtagaggtggaggctgcagtgagctgtgattgtgccactgcactttagcctgggtgacaaagtgagactctgtctcaaaaaaaaaaaaaaaaaaaaaaaaaaaagctagtagcacaccccaaaacttctagacagggcatggtgtgagctggagtagacaactagttcatggtaacaggaccagcagagctccgtcttgatgctgttattatttggtatctgttaggagctgaattatgtgtccccaaaattcatgtgatgaagccctaattcacagtacctcataatgttactctatttggagatacagccttttaaaggatggttaagttaaaatgaggttgcttggatggtccctaattcagtttaatttgggtccttataaaaagaggaaatttggatgcacagagacaccaggaattcatatgcatggaggaaagaccacagtggcaaaagacacattgaggaggtggctgtctgcaagccaaggcaaggggcctccggagaagccaaacctgctgacaccttgaccttgaatgtgcagccttcagaactgtgagaaaatcaatttctgttgtttaagccacctagtctgtcacattttcttatggcaacccctgtagataatacagtcccattctctggggaaacagatacctccgccagggtcctgatctgaatatgatttggggtgatggaacagaaacacccgaggactgtcgttggggaacaggaaacctgtctgtagtcctggctctgtctccaattggctacgagggcttgtgtgtactctagttctctttccgtgacactgcatttggggggaaggtaagggaactggggaaaagaaggcaaaatgatgacttaaagagactgatgaacccaaagctctcttgtgaagccccttctagaataagtccgtctcacgttacagtgcttaggaagtgttagatgtactgtcatttcttcaacatatatgtcctatattagtctattctcacactgctagtgaagacatacctgagatggggtaatttgtaaaagaaagaagtttaacggactcatagttgcacatggctggggaggccacacgatcatggcggaaggcaaaggaggagcaaaggggcgtcttacatggtggcaggcaagagagcctttgcaagggaactgccctttataaaaccatcagatctcgtgagacttattcactgtcacgagaacagcatgggaaagacctgcccccatgattcagttacctcccaccgagtccctcccatgatacgtggggatgatgggagatacaattcaagatgagattttggtggggacacagacacaccatatcatgtcttggcagccatctatattcaagacactattctaggtatgacataaaggatggcaaaaagtcagttacttaaaagtgtggaagcagagtgtcccaggcggaggaaacggtaaatgagacctctggtagtaagaagcagtgtagcatgtttgagacactgaagtccaatggaacttgggcggaataaatgaagggaagattcaaggtgaaggctgagaggtgtgcatgggtctgatcacacagagccttgtaaaccaaggtgaggacttaagattttattctagctgcagtgaggaaccagtgagtggttttaagccagagagagattgataagacatggaatgatatggtgtgatatatgaaatgacatgtttgaaatgatagatgacgtgattgtgatataatatcatgcggctgaggacaacactataactgctcggtagagaatggattgtcatggcctgggtgtggtggctcataatcccagcactttgagagctccaggtgggatgattgcttgagcccaggaatttgagaccaacctgggccacatagtgagaccccatctctattaagaaaaaagagaatggattgtgatgaattaggattggaaacacagagatcagttagaagatttatcagtgagaaaagagttcagttgcaagttaaagaaaacacaagtaaagctaactgtaacacacagagctttgtcttttcttgctgaataagaagctgagagggaggcaattgctgtcactggtccagccggctcagcaactgcacatttgtcaaagttcttcatccccagctttgtgattctctaggttattcattcttctgggatcgtagatggccaccacaggttcactgtggaaagaggggtaggaatttttaccagctgggtctgactccaccccacccccacccctacccaccgttttttgtttttgttttttaagatgaagcctcactctgttgtccaggctggagtgcagtggtgtgatcttgactcattgcaacctccgcctcttgggttcaagcgattctcctgcctcagccgagtagctgggattacaggcacatgccaccacacccagctttttgtatttttaatagagacaggatttcactatgttggccaggctggtctcgaactcctgacttcaggtggtctatccaccttggcctccccaaattctgggattacaggcatgagccaccgtgcccagccgtgtctgaccattttatcaggaaaagcaaaagcttttctagaatctatcaactcccttctgcatgtgtctatttggcatgggctgtgtcacatgacccctgagctgcaaggaatgctgggatacgatggaagcctgccagaggtagagccttgggaagggctgatagggcctctaacctaaatgtccaccaccagaggtattacagaggtttgagcaagaaattatggtggtcccagggatgatgcattctgataatcattatcatcaagaggaatgtctaaaggaaaggggaaaaaaaaaatcagacagtcacattgaaatgaggtccttaagataggccctaatccaatatgcacataaaggggaattttgggcacagagacagaggcagagatagagggaagatgatgtgaagaaaaacatagggccgtgtagaggcagaggcagagattgaaattgtgctatcatgaacgggggaatgtctgggactgccagaagctcctgaaggcaggaagcatcctcccctccagcctttggagggaatgtggccctgttgacaccttgatttcagacttctgggttccgcaactgcaaaagagtacattgctgttctaagccacccagtgtgcagtagctttctgcagcaaccctagggatgaatgctcctgccaaatgctgcctgcccttcaagatgagtgttatttggcagaggaagatgatgcactgcttattttaggggatgccctcacttttgggtccctatgtcacctgtgtgtactccatgccagtgtcttcccagcccctgccaggcaagttcgtgtggttctgtgataaccctcatctctataggttctgtgataacgctcctctcactgtgctgctccttgggtgacatcacacccaaggagaatcatgggaccacctccagagagattttcttagaggtgtggaacagaaaaaaaagcgtctctattcgaattgcaggatcttccttatagtcctggagaaacgtggcccagcattgtcttggtccatagcctgagcttaccctccctacgcaaccacagctgtgtgcagcttcagccaggtttgctttacctgatctcactggcttcatgtttattatcttattttcagtttcaaaagggcatatcctgccccctttcccaagatcagaggataaggaatgtcttgatgttctcagtcgtaaaattaggctaataacacctcccatggttgtctgtgaggacaacagaaagtaatgttttctctgaaaagtttaaaagggtaaatggcttcatcacatggtgatgacagtgattattccaagagatggctgtaagctccctgagaacagaggtgctctgtgtaaatctagtctgtctccccaggcttagtggttgacctagactataccaagagtaagtgtgttttttaaatttaatttaaatcaattcattaagcattgctaaattggaaaaccatggaatatagagatccagtagttaagagcctactgggagagacagcataataattacaataagtgcagaacttgcaataatgtaattgaaataatgtaatacaatcctgcttaatattacactgtatatattcattgacttatagactgagctccttatcttgttcattgctatggctttagcaccttttgaacagtggtgcttggcttttggtaggtggtcaacaaatgtgtattaagtatatgaactgttggaagggtctgctgtgaaggatgtgatttgctctctttgatggtggacaaagaaggtttcctggtggaagagattaatgagttgggttttgatgaatgaataggagtttccccagacacacggaggagacagaatggaatgaaagaggggttttccaagaagaggcactgaagggcaagacttcattgcttctttgatactccaatgccggcttcctttgggttggactctgatggatctaatcgaggattaggatggaggtaggtgggaacatatttagaaggatgccctgtggtttttctccttcctgctatttatatttccctctctgtctttcccacctgtttggtgatgaggaaggagctgtgtactggtttgaaacctattcacgacatagtggacccaacaccaagtgtcttattgtaaatggatccacttttactacagttactttaatggcatctaaatgataaatgttaataagcatttttgcttgggaaagcacaatggtattagcctgccagactgcaaacgttatttgctttatggaaggggatttcaaacaaggggttctggtggttgtatttttgcctcaacggttatttatagagaaagtatgggccattgcatgtttatagtatctcttttttatggctgcccaagttattattttttattggtttgggtacttaatttgcacatttgtaaacaattatgtagttacacagctgttgtaccacagagaccatatgcatttccatgttaagagaaaagtccgtgagggattctcactggataccatcataaaagaattattgtggtgccaaaaaaatttaaaaaaacgactagctcagaagttatcattgtgtttttatagtatttggagttaaataaatttaatgtttttttgctcacttgagttggagccaaactttataactgaataggagggttctctttcccatatttgagtagaacacatgatgttcaataaaaatgaatttgccagtcagaaaaatttatcttttagaaaattaatacactgagccaagcatgggtggtccatgcctctaatcctaggtactctggagggtgacggtgggaggatcccttgagcccaggattttgaggctaccctgagctatgatcacaccacagcactccagcctggccaacatagtgagacactacctagatagcttaggagagttccaatgtttctgaaggatgtttttttaaaagaagtattcatttaggtgacacatatttattgagacactaatatatgccaggaattattctattggttcctttggaggagacatgaataaaggcatggatgtgactgaggaggtaaaggtgaagaattggggaggggtggatggggctgactcatgacctaaagaacatggcatctggggctctcttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacacagcctggcatacgaacttccacacaaaacgggtgaccatggctgaagggttattctggggagccttccctgtggaagccccattaaccatccctgctcattcctcccgtgagaccaccatttgctaaatcttctgtcaggtgatgtgggatccaagaagaaacaataatcagaagcttgccttacaggcatgcacaatttcgggtggactgtcacatgtgcactgaaaaagtcgagaaatgttatgatggccctggaaggaggagtgtctagatgaaatgcgaataaataggagacaagtgtgtcgttaattaagaaggagaagggggactttaaggttaccttaaaagaaaagagacccctcaatgctttggaagagcctttttaataagctagtcaggtaagttagattgctctgtcttacactggtttagtaattttcatatatacttatttcctctgaaatgtattagtaacatttgtaatttaccaaatggaaaatatcacttaactttaagcttcatcaagttaagaatgaatttgtaaccaggggtattatgttttctcttattataacaaacaccaatcaaaaacaaacaaatacatgacgggaaagaaagaaaacccagcatttattggcagtatttttctgcaaaatattatttgtttccctttgcagttttattcattttaagcacgttttcaccaaagtgttctattctaagctagtctcaattcaatttaaagtggaaggtttttttcagtttagataatttacatataaaagcgttactgtacattttatgaaatgactgttttcagaaaacaacgatttcaatttaatcgtattgttattctgcaagttgaaatgcctcactcttgcttcttggtcttactgacaatattccttcttgccctaattttaaatggtgagtgtttgaaaattgatgtgcttcttttagaccctaccagtaagacttaaggcccactgtgattcgtctgatagacttgaagattatgtgcgcgtgtgtgaaacaagggaatcttaatcatctgaacctgacggttatatagatctttctgaattatttttctttcttttcacaagaaagaattatttttctttcttttcacaagaaattttgcttgccaatggtcagatctgttaacacgaaaactaaaaacttatacatcattttatattttgaaattcccaatttgcaatgttatttttttttcttcttttttttttatgacacttttcttctggaaaaaatccttaggacccagttactctctttcaggattttatatcataatgtgtctgtgagagacagagccagatgttcaggatttcagaccaccatatttgtcctaggaaacctgccagcatttcacattcttgacccttgaattgaatatgaggctctgactatataacagaaaacacccgagttttatgattctgcaagcgtggtttacactataaatttccaccggtctctgcttgtctcttctagaatttagggttattctcaaactctattatacaagcagtgcccaagtgccttcctccaaaagtacattagatactttcttggggagagaagaaattagacaggagctacaaagatggattaaaattaatttggtcctaactaaaagataagttcctcccccatcctcaggatgaaaccaagagcacttctccatcatcaggggagccaagtggacgctaatcaccaccgtgcctggagagttgcctttcagctggtgaatttactattgccaactcctgcattcttattagtctataagattgaggtcgtttattggtgatcacttgtagatatatatttatataaatctcttagcccagaatctccataaactgtttttcatgatgtggataccacgtgggatatgtcccacaattggcaagtgccataaatatattataggccattatactttctacagtatctttaattgatatgccccatgtctaagaaaaaaagtagctttcatgatgaaggtgatgaactacttctttccattattctatttcccccttttcttcttcaggctttaaagatatcataataccatttacatttactgtttaatttttaggtctgtatttaaaaatctgtgtagtgacaacaattattcttattgtatgaacatattgtcggctggagagtattcagctgtcagacaaagtgttctctaaagtgttcagccatcagacagaaactctattgctggtggcggggttgtgggctgggggaaccagagtatttgctcttctttagaagtcatcaatggtaagcctagggcagcctgaaccacttgtgttagaaatattttttataaagcaggacatgtgctttgaaatttgattcctccgtcactggctgtgtgaccttaaagaaataaattgacctgcctgagcctctcggaaatattggctggccagtagcatcctcacagagtttttctgggaatcgaatgagagattacatacacagggccaggtacatagcaggtgctccgaagatacccccgacttcctttcctacgaataaagaggcccaactttttgtccatatgaagaggttggcagagcaaacgcacacgtgcgtaggagctggaattgtcgataatgtcacaatctcaggaaacccaactttgtaaatgtgactttcctttgctactttttgcctattaagcagccatgtatgtaaagtattaaattagcatccaggcactttctttttttctagaaggtggtattttgcatattaatacttgcttaaatcaagaagctaagactttgtattatattttgctttacgtgccttgattaaggtcatgatcctgacattccagtcccaaaggagaccaaggaaatgaccagcacgtggctcactccctgtctgtccagtagaggacaccaaggcacgatgaccgcagctcctgtagtagttatggtcactgactccgggttcagacggacttggggttcagtcctagctctggcgcttaccagttttctcaagtgactttgagcatctttactcaaggctcttggtctcagttttctcatctgtaaaatggagatcgcagtatctaactcatgggtgtgtttaaggattcagtgatggagaaaatagctgaaaagtgaccgtatgaaatgagcagcagttgtcaagtacttggcatagttcctgtcacataggaagcatccagtaagtagtggtatctgttgtgattatgatcatattttatttcatggagttcagtaagagtacaaagcgaggagtttttctgcccctccagtagctgtagaatttgtgtgatgactatgtgagcttatcccctggtaggtataatggaaagactaacaagagtagaagagggatgtaactggagcatgatttaaaggaactgtagtttgtctctgtttttttttttttttttttttttcctctaaataaacaaaggaatagaagatcctgtgaagagctgggtgtggtggctcatggctgtaatctcagcactttaggaggccaaggcaggaggattgcttgagcccagtagttcaagatcagtctgggcaacataatgaaaacctaatgtctacaaaaagtataaaaattagccaggcgcagtggctcacgcctgtagccccacctacttgggaggctgaggcaggaagattgcttgagcccaggagttagaggctgcagtgagccatgatcacactggagcactccagcctgggtgacagagcaagattttgtctcaaaaaagaaaatgatgtgaggaagccaggaatgatgagtacctggattaaactaccttaaggctgattgagtaaaagtgaaagatcatcccgtcaactgctggcctgccgcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggggtcagtgtctgtcaacgtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtgctctctgggttcactcctgacagttctttattgctttcccacctctgccaaggtcaaaaatggaacttgcttcttgttctcgtatcactcagactaagcagttgatgtaacagataacccccaaatttcagtgatttcacatttaatctgtaaaaaatgaggatttgtttatagccccaaagacagtctagtttggattatttgaggacctagacttcacctgcacagtggtttcaccatccatccccccatggcctccatggtaccctctgattcaggctcagcaggagcgggagaggatgcataggactacatgttttctgggccaggactggaagcagcatatctcagatccaacctctttaccttggcaaaaattcaggatgtgcaggacgaggaggaaaatgggagtagtgactatttagccagtctttgccacatcccggttcatatctcactccgtcatttataacctgtaattaaatctttagtgagtacctgtcacaggttgagcagtcttctagggcctctggttaccagcaatgaaaaaagccccatttggtaaaatacagtagttggattcattatctctgtgattaacttgcataaaaaagagacagttttcattgatgtgacctttagcaacaactcctaaaatattttttttccttcattcctgcttttccttgttccagaagaagttaaggtaaatggcttttagcacattgcacccccagcttttagcacattgcattatcattataataaatgtttacggttactgatattattatagttctttatcgacattattacagtccattatttacagtccttatgttatttaggaggggaatttggggacattgacccacttatgtgtagtcccctagtgaaatgacaagaatccccagagctgggaaaacatttccatgcaattccctctcagtttacatcaaaatcagctcgtcacccttgagattgaagctcgcactctgtaagctctgaataaatattaaccatctcctgaaccctgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtgatatggtttggctgtgtccccacccaaatctcatcttgaattgtagctcccataattcccatatgttgtgggagggaccgggtgggagaatattgaatcatgggggtggttcccccatactgttcttggggtagtgaatgaatctcatgagatctgatggttttataagggggaaacacctttcacttggctctcattttctcttgcctactgccatgtatgatgtgcctttcgctttgcactatgattgtgaggtctccccagccacgtgaaattgtgagtccattcaacttctttttctttataaattacccagtctcaggtatgtctttttttttccttttttcttttcttttcttttcttttttttttttttttttttgagatggagtttcactcttgttgcctaggctggagtgcagtggtgcaatctgggctccctgcaaactccacttcccggatttaagcgattctcctgcctcagcctcccaggtagctgggattataggcatctgccaccatgcacggctaattttgtatttttagtagaaatggggtttcaccatgttggtcacggtggtctcaaaatcctgacctcaggcgatctacccgcctcagcctcccaaagtcaggtgtgtctttatcagcagcattaaaacaaagtaataaaattggtttcttagggttggatggcttaaaacaacagaaatgtatcatctcacagttctgaaagtgagaagtccaaaatcaaggtgtcagcacagccacgttctttctgaaggctccagggatgatctactccatgcctttgtcttagcttttggcattgcgggcggtgcttggtgttccttggcttgtaggtgcatcactccaatctgcctttgtcgctgcatgtcattcacattgggtctctctgtctctactccttttcttctcttttttctcctttccttttctttcctcttcccttttcctttcttttcttctcctcctccttctccttctcctccttctccttcttcttctctttgttctccttctagttctcctcctttcttctttcttacttttactcctccctgcttcccttccctccctccctcttcctccctccctccctccctccctctctgcctccctctctccctctctctttttctctttctctctttctctttctgtgtctctcttttctctctctctctctttccttccttccttccttcttttcttccttccttccttttttcttcttttttttggaaacagtcttgctctgtcacccaggttacagtgcagtggcatgatcacggttcactgcagcctcaacctcctggggtcaagtgatcttccccacctcagcctcccgggtagctgggaccacaggtatgcaccaccacacgtggcgtatttttaaattatttgtggagacggggcggggaggtctccctgtgttggccaggctggtttcaagctcctggcctcaagggattctcctccctcagccttccaaagtgttaagattacaggcatgaaccactgcacccagcctatcttaattcaatacacagtagtgctttttgttcccccatgggatagtaggtaaattaatggaggaagggagtcaactaaacaatttatttgagcaattaatggaggaagggagtcaactaaacaatttattagggctttatgtaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcagtttcttcatctgtacaatgagagttgaggggagctgagtcgggagttgaaatggtcactgggtatcatttccgtgggtggctctaacctgttagggctgtctgcacagtgctgagcttttgtgtttttggtcatcccaatgtgcttttcctttttcctgagagcagccctctacatcttccgtggtgtaagttgccttattccagcacgtggcatcgccagtcccagtgcccttggcagaccatgcagaatgcatccatggaatatgaaaaatgaggcccagtggggcacagtggctcacacctataatgccagcactttgggaggccaaggtgggcagatcacttgaggtcaggagtttgagaccagcctggccaacatggtgaaaccctgtctctactagaaatacaaaaattagctgggtttggtgacaaacgcatgtaatcccagctgctagggaggctgaggcaggagaatcacttcaacccggaaggcggaggtttcagtgagctgagatccagcctgggtgacagagcaagactccatctcaaagcgaaacaaaacaaatgagggtcctcatcagcgtgcctttgacactgtcctctggtcctggtgatctgaatacatcaccacagaactgccagggtacgtgtttcctagcccatagcgagtcccagtgaaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcccttatgtcaagcttctttcagtaacaactgaaaggctaatagtagtgctgtgtggggaggactttggacttggggattggactccatgggagaggtcagctccttgtctccctggtggtgagacagggaatggtagagtgtgtcctacctatgtgcctgccttgctctacatcagtgcttcttggatattttggtatcaggactctaaactcttagtagttatccaggacccaaaatagcatttgtttatctgggtcatttttactgatatttatcatactagaaattaaaatagaaatagtcaaattctttattaattcgtttataagtaagaaacctattacaagtgaacatagataactcccttcctctttcctctctccctccttcctttttttttttttttttttttttttttgagaaagggtctcactgtgtcacccaagctggagtgcagtggcccagtcacaggttactgcagccttaacctcctgggttcaagtgattctcctgcctcagcctcctgagtagctgtgactacggacacatgccactacacctagttgatttttgtattttttgtagagatggggtcccactgtgttgcccaagctggtctcaaactgaactcctgagctcaagcgattctcccgccttggcctcccaaagtgctaggatgatgataggcaggagccaccacacctggccatggataacatttctataaaatataaccatattttcaaacaaagagaaaagtggcgttgtgctacatttcttctccagtgcttggttccctagaagacagccagattctcacttcttttcctgcattcagtctcttgtgatatcacatggcatgtggcctctgaaaaactccgctgtctagttgtaaaagaatacaagtaagtagtcaagtgacaccttagcattctgatgaaaagagctttgacctcacagagcttctggaagggtctcagagacatccctgagggtcccttgactgcactttgacaaccacaggtctacatgatctgtatagccttttccagttttcacatcctatgattccaagagggaaaacaatcttccttgtaaagagagttaagtgacattgtgtccttgtctacactcagctgctaatatgctatgggacctcaggtatgtcacttaaaccttgtgttggagtttcctccttgttacatggaggtcacaagaataacaaactatgcatagatcacctaatttagtcattccaacggtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcaatcccagcactttgggaggctgaggcaggcggatcacttgagctcaggaattcgagaccagcctggccaacatggtgaaaccttatccgtaaaaaaaataaaaaattagccagacatcgtggtgcatgcctgttgtcccagctatttgggaggctgaggtgggaggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgcaagcatccttatggaagaaggtcagagggagatttgagaaagacagaagaggaggagtccatgcaaagataaaggcagagggtgaagttgtgcatccacaagctcagatatgcctggagccatcaggtgctggaagagatactggaagatctcttccagggcctctggaggaagcacagtcctgctaactcttaatttgggacttctggcttccggaactgcaaaagaacaagtttctgttgtgtgtaggcacccagtttgtggtaatttgttacagcagacatagcaaactaatgcaaatgggctttgcttgaagtccctcagctgctaagggtcagaaacaggatttgaacctacagttttgaggcctgaacctgctatgcagtgctttcttcctgatagtgaaaccactgtggtcccaaacccacagggctctatttagatttaaacaagactatgaatgtaaacagacacagtgcaatgccagatccagagcaatcgaaggtcatagtttcctcatccctcgaagctgccaccttgcaacatcatccttgtgttacttccagttgtttcttatgataagtaacagtgactttgatatatccattttttagttgtgtacatggtggtgatggtgttttactccttgctataaacgcttaaggattccttagctttagggaatgaaactacttgggcaagaatataaaattttgttctattttattttaaagctctggttacatatggtcaagttgcttcccaaaaagcgtctctgtcaggatgatcttatgaacgacgttagtacctcaattttactgtcccatccttttttcctccttccttgcctccttccctctctgcctccttccttttcttcccatttccttccttccagcattatcatataagccacgtgctgggatgtaccaggcacactagctctataggtaagatatttcctaggactcatcattcacatgagtccaggagaaatacatcttttgtttgtttgtttgttttttgagacagagtcttgctcaggctggagtgcgatggcaccatctgagctcactgcagcctcaaccgcctggtctcaaatgatccacccaacctagcctcctaagtagctgggaccacaggtgcatgccaccacgcccggcaatttttttttttttttttttttaagtagagacagggtcttgctgtgttgcccgggatggtcttgaactcctgggctcaagcgatactccctccttatcctcccaaagtgctgggattacaggtataaaccaccaacccagcctcaggagaaataaatcttttaggaaaaaaaagtgacacagttttctcttgtggcttatcacttggaatgtggagagtcatttccattagggaaccaccaggaatcttggcaacttagcagccacaggagatgcagaaactgagtagtgatttaaaaattcagatcactttgtttgttcccctagaataatacattattatcattaacaaagtaactcaacttacagtatcaaatcaactgcagagccattgatattgatgttaccgtactatccaacacattatgtttagtgttgatttaagaaaatgttgattttatttgatgtcatgggtgggaaattgcttgcttttgttttttgagtgaatctggtttaactgggctgtgtaagccaaggagttctaactcttcttgggcaactgagaccgtggctaatatttcattatctgtattaattaaagacagggcctggtacttgacatggcagtgtgatgtgtccaaggttagacccgaggtaagaatttagagcacagaggcacgctcacatgaagctgccaattcctctgctttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcctttcattccttcttatctatccctttcttaccttctttatttcctcgtttatttgggctttttcggttgtgaagatcagtaccttgaaattcagaatagatggcatgaagcacttcagctttgcattcaagtactcatgtgtatgatcaagcatcgtcatgatcattattgactggaaagcctgtaagaagaagcggataaggccagggtgcagactgggcagtagttccctgtcatgaatccactctgcagttgttttataacatgcaacaaaaactaaagtctaatagcactccccaatgccaattttttttctttctcttttttttttttttttttgagagacagggtcttgctttatagcccaagctggagtgcagtggtgccttcacagctctttgcagccttgaactctgggctcaattgatcctcctgcctcagccatctgagtagttgggacaacaggtatgcactaccatgcccagtgaatttaaaaaaacaaacaaacaaaacactttttgtagagaaagggtcttgctatgttggtgaggctagtctcaaactcatgccctcaaatgatcctcctgccgtggtctccaaaagtgctgggattacaggtgtgagcccccaaccccaaaacttgaatctgggccacctttactgacttacttattactatgtagaatatggtacaggtgacgctgcagactcttgaagttaggtcataaaagatgatcctgcttccgtctggttgtgtctctcactcatgggatgcttaccctcaaaatttggccaccatgccatgaggaaactcaatctagcgtaggtaggaagaccgtgagaggcccaaatagagaggaattgaggccgccagtcatagtcagcttcagtcatcagataggaagccaacaactgagccctcagatgattccagtttccaaacactgtgaagcagaggctgactgtcccctttgtgccatattcaaattgctgacccacagaattcatgaatagcgcatgtggtagatttacacttcaaagtctttgggtaatttgataaagatgtggtaactgggctatgctctaatcaataatcttagctaagatttatcagaaattaaaactgtatacttaactaaccacctagataggtgcaggcatatatgaattcaccgaaatttgactcaactcccttggttaatttaaataaaataaaagtaaataaggggaaattgcatactcctatctggactgttttcttatggttttggaatctctggcaggtagaagtaattatttctgtaactcttaggcagggcttaggaattatctcccttaggtttgacttctttctttcttgagaataagcgctgtgtttcgcaagagtaaagaagtggcatttattctgttgtcacagcattactgagctcgagtggatggctctttatttccttctcgtcttttcttttctagtctttgtcaggacccattcctttacccctctttgcttttacggttttcacattttaataatgtaaaaccatgttccccaaacttccgccttttttgtcccatttgctccgctgttacatcatttgtttttaattacgttcatatttacttatgtttttatgcacagctatttataaagaagattctataatactaaagtaaatagaagagcaatatcatttgccataaatacaaaggatccctgaaaataaatatactgccagcctgggcaacatagggagatcactgtttctacaaaaaataataaattagctgagtgtgatgttgtgtgtctgtagtctcagcttcccagaaggtcaaggcaggaggattgctggagcccaggaggttgaggctgcagtgagctacaatcataccactgcactccagcctaagcaacagagtgagaccttgtctcaaaaaataactggctgggcatggtggctcatgcctgtaatcccagcactctgggaggacgaggtgggcggatcacgaggtcaggagatcgagaccagcctggccaacatgatgaaaccctatctctactgaaaatacaaaaaaaaaaaaaattagccgggtatggtggtgtgtgcctgtagttccagctactcggtagcctgaggcaggagaatggtttgaacttgggaggtggaggttgcagtgagccgagatcatgccactgcactccagcctgggcgacagagtgagaatccgtctcaaaaaataagtaaataaaataactaactaggctaggcacagtgggtcatgcctgccatcccagcactttgggagtccaaggcaagaggatcacttgagcccaggatttcgagaccaacctggacaacgtacagagacctcatctctacaaaaaataaaacagctaggcatagaggcacacctgtggtcccaggtagttgggaggctgaggcgggaggatcctctgcacccaggtagccgaggctccagtgagtcatgatcatgccactgcactgtagcctgggtgataaagtaagatcctgtctggaaaaaaaaaaacacaaaaaactaaataagtcgtccatccgtccatctattcatacacacacgtaaaatgaaaactaaagcaaaagagtagtattaaattctagttagagacttaggatttccagtgactgaaattggaatgttaggtgttaaagacacacatcaaaatgagactcttggttttttttataagtgcaaggattgcaagatacctgaaaagggagtatttttcccccacatgcatctcaggagggtagcctcagatataagcttaggagtcctgaatttatcatcaatatttatatcgctgtttggcccctaacaccttccctatgatagccctaattggaatatagtaaatgtttgttgcatgaatcaacctatttaacctgtgcgtccttaaatcttacggtctgcgggttgacatttctagtgaagggagacatttctttacctacctgggacctcagaccttggacctcactgaacttgagagcagagctggtttatgtgtaactgaacctgatggttagtttcctgtttcaacttgattaggtcccagtcacagggtgcccacatgtttggtcaaacatcactctggggtgtctgtgagtgtgtttctgggtgaggtgaacatttaaatcagtcacctgattacagcagattgttctcaagtgcctgagcttcgtctcatcagctgaaggtctgaatagagcaaatagactgaccctacttcaaagagaactccttctgcctgatgactcaggtggggacttcagtccttttttttttttttttttttttttttttttttttttttttttgagatagggtctggctctgttggctaggctggagtgcagtgacgcaatctcagctcactacaacctcagcctcccaggttcaagcgattctcctgcctcagccttcccgagtagctgggattacaggcacccaccatcatgcccagctaacttttgtgttgttagtagagacagggtttcaccatgttggccaggctggtctcgaactcctgacctcagatgatccacctgccttgacgtcgcaaagtgctgggattacaggggtgagccaccacgtctggcctgacatcagtcttttcctgccttcagacttgaactgaagcatcagcatttcttgtgttttgatcttgctggagttggactgaaactacacatcagttctcctggctctccaccttgcctatagcggatcttgagactttttcttattttatctatctatcaatccattggtcatcaggttctccagagaatcagaaccaataagagatgtcatacacaccacacacaaacacacacacacacacacacacacacacacactaatatggttctgattctctggagaaccctgactaatacagaggcaagatcctgttttgacgtgcttgaactcgaggacttatgccgatgttaactctgagtgttcctgttttatactcagccatacagatgctcagagcatacctgcacaagtcaactttttgtgtctgcaggcatgggcctgccctgtacatgaggagacagcagacagttcctctccctgctgctggcctcttcatcttctcctggcgtcaccacggccaccgtgatgcctggctcaagtactagttctatgtcaatgatggtaccaatggactctaactttagaatgttgttgactgaaggcccctgccccctgccttgctttaggtggaggatctggtcaaggctttgtgaatcaggggatgctccacacctttctgctctctgcaacagggccagggatctgagtcccttcttgtctatccagaaaccgtatacccagtgttctctttctctcacctccgaataggtgggccttcccaatttacctgtgagaaaactagtgtgccacctcaagcgattctggcctctgttgactgtctgaaccctgtgttttgttgagtggtgcagactagagatgaagacagggattcggcttcgcttgctttatcaagggaatgttcttgggacaaatgtgtgacaggtgaggaaaacaacataggaaaggagacagaagtgaagagaagatgtggtctcaaatgaagtctggcttcaggtttatccttggggggctctggaataaaaatcacacctcaaacttgacccgcttgaggccagaaggccgggctgtggtaccttcgtgtcggacagtcataggctatcctcatggggacctgtatgttgccaggtgtcttgggcaaggtggacaaggatgccagcaaagtgaaattttccagagaaggtcacaaaagctaggaaatggcacagcagctgctaaaaggggatctgaccaggccaccaacagcttctgcttcttcccaaagtcacctttgctctctcctgaccaccgttggtgtctcaaagtctcacatgtgacaacacacatatcatcaaattcatgagtatccatggcacacaatgttttccttttcttctcttctctttctttcttgttttgttttgttgttttattttgttttgttttactgagataggatctgtctctttcccccaggctacagtgcagttgcgtgatattagctcactgcagcctcaaacttctaggctgaagtgatcctcccacctcaacgtcctgagtagggagggcactacaggcgcatgcctccacatctgactaattactaaatttttaaaaatttttttagacactgagtctcaccgtcttgccctggctggtctcaaactcctgggctcatacaattcccctgcctcagaatcccaaagtgctgggattataggcatgaggcaatgtgcccggcccacaatggttttcatatagctattgtgtattgcgttattgccttagtcacagaagcccataaaaaacagattccaataaagagactaggtttgcagagtgatgagtggggcccttgaaataattacatttagtgggttatatgtctatttttttggtcgttccttgctcatctgtctttatttttgtttatttatttattcatttatttgagatggagtctcactctgtcacccaggctggagtgcagtggtatgatctcggctcactacagcttccacctcccatgttcaagctattttcctgcctcagccttctgagtagctggaattacaagcgcccgccaccatacttcgctaatttttgtatgtatatgtgtatatatatgtatataatatatatattttttagtacagatgcggtttcatcatgttgatcaggctggtctcgaacttctgacctcagaatgatccgcctgcctcagcctcccaaagtgctgggattacaggtgtgagccacaatgcccagccttatatatgtatttattaagtttggggggaacaggtggtgtttggttacatgaataagttctttagtgatgatttctgagattttgatgtacccatcacccgggcagtgtatactgtagccaatatgtagtcttttattcctcaccctactcccacccttctccctgagttcccaaagtccattgtatcattcttctgcctttgcatcctcatagtttagctcccagtctacagggttatattaaaagaggaaaaggggtataagaatctaggtatcatggatgatgtcctggtcctttgctgagtcccatttttttcttcctcacctgatttcccccatctggcagaaacttttacagagtgtttgcagaagagaagcctgtaaactctggagtgtgtcctgggtggtttgtccttgggccactttattccctcaccgatcccttccaaaggccatgagttcccagtcagtcatttccctatatcagtatttattgttttaatcaattttccccatcccaagagaaaggcaccaacatgagtccatgtgttttaacatagcaggggtttccctgtcagagcccggtggacttctgtggccataagcaagtcaaggtgggctcctaagtggcagctgcccacttccagaaagctagaggttctaattatgtcttcctgaaaaacagttcaattaggtaaagtgacattttttaagcccttgtgtgtgtccgactcataaaagttcagaaggttgttactgagaggagactgcagtcattttaagatttcagtagctgctggagttgagtagataatttttcccctttctaatattatatattaggtgtgctcttgtgtctgggtgaaacagagcaatcacaatgattgttttttcagtatggtaataattaggcataaaatcaatatttatgtgtaatgtgccatttgaagattctccctgtgtatgatgctgggttttacaaaggaaaatctggattcaggtggccaatgaagtgtcacgatataaaaagagaattttgaaataatgagaattccactcctttgggagtattggcatatgttaaaatacaaatatatctgtatttttctcacttttattagaagagtgcaagtttgttcaaaacaactgctggattatctagtccctgaacagccatttatatttttgttacgcttgtggtttttaaatcatcctcatttccttgatcgcatttgcttctcctggctagaatgtgtaggagacgggtcggggagactgtgcccatttgacaggtgtgaatgcgaacagaggctgcagctggttagaccagggctgtgcaaccctagagccattgccttgaccacaaagccacagtctcctagtcctaatattaagaggtaggaggtagatagagattgtcccttaagccacattccattcttcatatttttgtacccattagagtagtgctgatcatttgccttcattgctggggtcccctaaatgcaacttctcatgctgccaatttagtcctggccctaggaagacgtaggtgataggatagaattcaacaactagaagccatggtttcctggttggatagacttcctctgccaccagaataaaggaatagagggttcctcactgtgccccatagctgcaaagtcacaggaagcttgcagcaggccagtggtaacctctgagtgacttctgagttcccagagctaggaccatgacttttcccctggattcttaagtacccggctaaaattgtgtttgccgaatgaaagtgtgatcctggaggccatgttgtttgtggttcatggaagggtgcttgttcagcttggtcaaagcaagatggtcatactgggttttggtgcccagacgttcccaacactcgcagcagagggcattaggatcatgtttagccaacaattttggaggcacccaacagtgattggatgtcatgtgctttcagaaggcacactacacatcttcggttcctccaagctctaggaaagggttgtggaattgggttgggtgacaacaggtcggtaagaagagggctgggctgagtgtaaagaaattccttggctgggcatggtggctcacgcctgtaatccagcactttgggaggctgaggcagataaatcacctgaggttaggagttcaagaccagcctggctaacacggataaacctcgtctctactgaaaacacaaaaattagcttggcttcctggtgcatgcctgtaatcccagctactgcagaggctgaggcaggagaatcgcttgaacccaggaggcggaggttgcagtgagccgagatcgtaccattgcactccagcctgggcaacagggagagattccatctcaaaaaacaaacaaacaaacaaacaaaaaccccagatattccttattatggaagaagaagcaggaaatatgtttttgaataatctgggtcagagaattgtgcatttattattgctaggatgcatatacacattgaactcagtcaacttactctctctaaattatctcaccggtggagacattgcctcaggagtcgagccctgtggtgtgcctcctgctgtcaccacatttgaccacctaactgaccccactgtggtcacctttgccacctgccctgctttggtcccttctctgcattcgccccatgccatgtagcactgctgagtttgaaaataattgcatctcctgaaaactccatttcttagagagtgagctccagcaccatcagcctgaagttgaagaaatgggactcaggaaggctggagtcttcaggcgttcttacaatgctgatgcgactcagacggctgcctgcactgtcctctgtgcttctaagtgaaattacccgtcggggggctcctgagagttaaatcaagcagcctctcttgaagcacagtaaatgctgacgtgatttgtgaagatggctctgctaatagggttggcagcgtcctttggcttggacctttggaccccggctggctgcggaagggagggaaggcagccttggaaaactgatttccgttgccctctgaccatgagaagatccctgtttaggagctagaattcagagttccacgtgtagagggggattccacagtgtgtggtgtgcagagagcactcgtctttcaggcatggggcgccgtttcatttctcctagtgctggaaggggacttggtgaaattgatttggcaaaaaggttaatgtgttgttatggctgccagttggccgattgaagcgctagtaattggggcaagggaagcattcaatttgacacaccaaatgcaggtccaccctggtggatatcttggttgcagcactctgtgtgtgtacgtgtgtgcatgagcgtgtcttagagatgcttttgctcctcttataactcctatgataaaaagagttgccattatcatcctttgtctactcaccagcccccaccagaaaccctcacagaaaaaataagagtttattttttcactatgtcacattgttggagaactgtgcaaatacaagcccttctcttacaggccatgggtctcctaagtgggatacaccacgatgatccactggggcagtggccagcaaagtccctgtccagccagccactcgtttttatcaataaatttttactgaaacacagtcatgcctgttaggttaggaactgcctagcgccacttcacactgcagtaggagagtgagtagttgtgacagagaccatttatcccacaaagcctagaatctttattataatcctgtaacagaaagcatttactgactccttagcattgccatgtttagcaaataaaattgcaggatgctggtcaggcgcggtggctcacgcctgtaatcccagcattttgggaggccaaggtgggcagattacttgaggtcaggagatcgagatcagccgggccaacctggtgagatcccatctctactaataatacaaaaaatagctggcgtggtggcgcatgtctgtaattacagttactcgggaggctgaggcaggagaatcacttgaacctgggaggcagaggttgaagtgacccaagatcaccactgcaccccagcctgggcgacagagtgagactgtgtctcaaaaacaaaatatctggctgggcacagtggctcatgcctgtaatcccagcactttgggaggctgaggtgggtggatcacttgaggtcaggagttcaagaccaggctggccaacatggcaaaaccctgtctatactaaaaatacagaaatcagtggggcatggggcgggtgctctgtagtctcagctactcaggaggctgaggcaggagaattgcttgaatccaggagacggaggttgcagtgagttgagactgtgccactacactccagcctgggcggcagagtgagacgctgtctcaaataaatacatacatacaacataaagtaagatgttaaagtaaattttaattttagataaacaatggataattttttagcaaaaggatgttccacatttaactggacattatctctgtctctctccctccttacctgcctcctatcctctcttcccaccccctacgatgtctatgtatagtttcaacctggcaaccctgtgacctcagcactaggatatggatagaaaacatagtagcccctatttacctttatcttttatctcaacccatttaaatgtcttttccttgcaatgttttgtaatattacatgtagattgtacatcgtttgtcgataaatcagtgtacaaatactaggggtgagtgtgctcaaaacttatttttactgataatagtccatgatcaaggcagtttggagaccactcaggacagggaaaacgcagactcatgtgacccatcagggcttcagggtgtcctctggtgaagggcagcagcaggacagagccccacttctagctctggctcaggttaagtgtttcagcgccctggcttctgtgtcttcatgtgcaaatggagataatagtcagcacctatgcaggttactgtgaaaacaggttggaagtatttatctacagcgtggaccagagcctctggtatgtactaggtgccctagaaatgttctttcctctgactcaaatgacaaatcagtttctagggaaaggaacgcacagcgatccccagcgcatcacgagaaatctctctccagctttgccctggctgcgctggtgactcactcggggctaaaactgtttatgtctgcggagtcagagcgttctgccctgcggtttcagttcacatggggttgggcgacacagttttgttttcactttggtttatcgtgtgagtttccatccatcaactcttttgtatctgatgttcttgggaaactttgcgggaattcacttgaaattgtccagtgaacagccattgcgagtctcatggtcagagccgggggcttcccagtgtagggtctggtcaaggaaagggccacttcctgggcctcccaaaaagaggaaggagaaggccctggcttgtggaagagtaagaggggcctcgttaatgtctcccaagcacagtaccccaactccccacatacagtcccaacccttactgcagccgggaggttaggtgtctgccgtgctcatgaacaggaagtgaacccgatcagcccccgaaggaaacatccgtctctctccttggaggagacacttgagtgtctttctctgtgtgctgcagccgttattgatatcagttcccaggcaaggttcatgctggcagaggaggccactctttctgcactggagagcaaaagccatcttatctctctgagtgcaaggtgacagtgaggagattggccctgtgtatccctcagagaccagtattccctcatttgccaatctagaaagaagactgtgtttgctgtcatttgtttcttaactcattgattctcaaacagaatcttcccagggatctgcttcatgctgtattttgtactgtgtcctgagatgatgaggattcggtgtctaccctcaagaagcatcatttagagaagaaattagaaaagtaagtgaggcaggagaacaggatctggaggcagggaatctaaggctgattcacgttgactttgtataattaaatcaaaaggaaaacaccaactttccacaactaagttataaaaggaccagaggctactccctctgcaacccctccccacttttctgagttgcagatggaaaattgaaagtacccctgattggttgctttccacgaccattcagccgtttgcataggagctgtaactttgtaacttcgcttcaccctctgattggttgcttttcacaacctatcagacatttgcataggagtgtaacttctttccacaaccaatctgactgattgtgggccattacttcatttccatgaggtgtacaccaagtggccaatgggagacctctatagggtatttaaaccccagaaaattctttaaccaggctcttgagcctctatgcttgggctgctcccaccgtttggagtgtactttccttttcagtaaatctctacttttgttgtttcattctttccttgctttgtttatgcgttttgtccaattctttattcaaaacgccaagaacctggacgccctcctccagtaacataatgaatgtctggatgtggtatgaagagtattggggtacaccacagcagcgtgtgctctgagaacacagtaaacaggcatttgatacagatcagaaggtccgtaaaggtggtatttgaactaagttttgagagctgggtaagagtttgtgaaaagacagggcttaaggaaggatatagtaagctgaaggcacaggactttagaaacacataggctataactgcaaggtgtgtctcagaaggtacatgtgacgtttcatttttatttgtttgcttttttatagtgactgcatgatcattatatgcagaagacgcttgaaggggccagattaggaagggcccatggtccacactgctttttttttttttttttttttttttttgaaacggagtatctgtctctcacccaggctggagtgcagtggcacagtcttggctcattgcaacatctgcctcctgggttcaagcaattttcttgcctcagcctcccgagtagctgggattacaggcacctgccaccacacctggctaatttttgtatttttagtagagatgaggtttcaccatgttggccaggctagtcttgaattcttgaccttaagtgatccacctgcctcggcctcccaaagtgctgggattacaggcgtgagccactgtgtatttctattaccagcctgcactgcatttctattacccgaaaacagtgtggaaaatattaattacaagggagattaaaaagtaaaactggttggttggcctgaagacccacatggtgacttcactaaagtcattgggtaagcaaagaagagcaacactctagttttcctccaagcttcaacgttttctgtttcctcctatgtcaggtcttaatttccctacctgattcaggctgcgctaagctgacttcatcatgactcctggcttccccagtccctgcttcccagcacataccatttattcagtgttggccagtgacgcctgccactgcattttattgatgaagaaatggagatctcaagaggtaaaaaaaactgactataggagccaagactagtttagagtggagtttgaatatgaacatgcctctgtctgtgaaagccagtgtcccttcagccaggatctttcctggaagaactcagtattaaggcacttgattagttcttcctgttggtggactgattgattacatttgaatctttcagcaagcttttggctgagctgggcatcttccccgccttcctccacctctgccttcaaaagcctgaatttccaaggctttctgccatgagtacttagctttgaaaaacatgagcatatttttcattcttcttgccggcctctccctgtgtcatgcctgttattcttttctccctcaacattgacctaggtcagaaggaccctattttaatgtttagcgtttgggggtcactccatagagaggggtttgtggaaatcctttttttttttttttttttttttgcttctttctgtggatctgtttggaaatgtaacattttaaagcccttcttggctggaggattttttatggtaaacataaaacgttcattgaaacattaaacattttacagctgtttttcagcacataaattttcatagacatccaccccctcactgccacaccccctcatagatttcttcttttcctcctccttctcctcctccctcttcctcctctttttccccccccttcaaatagttccaagaccagagttgagggtgggtgggtagagggctagtttacagataaaatggttggtgtagatcatctagtttggaaaaagcacattgtattttaatactaggaacgtgtgcatgccagaaacctgccaaggaaaacactcccgctgctccttccagccctgactccagctgctatgaactggaaccctgcaccacgtctcagaaggctactgggaagggccataatctgtatccatccacaaggagaggtggaggggggctactctaagaagccaaaatgctcaggaaagccagagctaagatggtgcaaaccagcatgtgatttgtccaaggacatcgttttgatatgatgaaccatgggtggtttgggcatttgtcaaagcagggtcagcagaaagctgacgtagttgggtctaaagtacaacaggactgagcatggtggctcacacctgtaattctagtgcattgggaggccaaggcaggaggattgcttgaggccaggtgttcaagaccagccttggcaatatagcaagacattgcctgtacaaaaaatttaaaaattagctgggaatgatggtgcatgcctgtagtctcagctacttgggaggctgaggcaggaggatcaactgagcccaggagtttaaggctgcagtgagccatgatcatgccactacactccagtacactccaggactttaggcctgctaaagtgcattgtagtaatactagatatcagcacccttgccatggcctcatgagcagtgaaatgaactttcttgctcctggatttttggctcttggccttgtaatttttttttttcatgggatattagtcaacatgatgtgagcagagtcttgagatgtgcttgcatgattggctttgtactcctgcatttttcccatagccaatgccttttcttcagcttgggctgcagaatgagatagatgaaacagacctgaatctgacttataccctggagccattttcagcaaacccagtcaatatcaggccaacctcaaccaattcttagactagtgagtgaggaaaataaatatttgatcttgtgaacccttgaaattttgaggttgtttgttatgcggcagtattttggcagtagctgatgaatacaccactccccatccctagtggcttcctataccatttagaataaaaatacacgctcttttccagggtctacatgtcctgaagacctgaactcctgcctgcctctcagtttatttcctacctcaagtagctgtgcccaatgtcctcccaatatcctgcaaccactctagtcttctttcttttcctgggacccacagagcctatatctgcttcaaggcttttgtacatgttgtttcttttgcctgggaagagtggtggggggcactttcttgcccattttttttttttttttttgagatggagtctcgctcttgtcatgcaggctggagtgcagtagcacgatctcggctcattgcaacctctgcctcccgggttcaagcaattctctagcctcagcctcccaaattgctgagagtacaggcatctgcgaccacacctgtctaatttcttatctttctaacacagtttaaatatcactttctcagaggcctaccctgaccatcctacttaagtaacaataataaaataaaaatacccatcatttatgaagtgctcattatgtgccagcgttcttagcatctcccaacaaccctaggagacaggcattacaatgagccttcgtaatgttcagatgaggaaactgaggctaagagagccttggcaagctgagttacttagctagcaaatggtggagtcgaattcaaaccctgcctctcctcacccactctgtttcttttcttttgagcacttaccactttctgaatatgtatacaattgtttcctcgattactgtctgcctcttcttccctagagcgtcagcccatgagcttatccagcctacagaggagatgctgcagcttggcagagcatggattgctcaacataccagagtttagtcctacctctgtctccaagctgctccatgatcaaggataaactataatctttctctctgcctcagtttttccacctgtcagtggaggggcatgctcttggatgcctgagtttttcttagactcagcatcctgcagccgaaataaccatgcttcttagtggtcctcttgcgtagcagcctaagaaactccaagtccatctgcgccgaagagtattgaacttggccagagcacttgggatctgcagaagtgtcccctgtctgttagttttttcacagactctgctctttctctcccagaccggaccctccactcctctatctcgcatttatccattgcaccccgtgtcattgccgaattcctgagctacaaaggtgaacaggcaccaaagctagggcagtgtccactcaatacatatctgatgaatgaatgaatgaaccttgtctaccacagatagctcaccacaaataaacattttaatctactataaaatagctcaaaagactctatgcaaataattactgttacccagtggtggaagtgcttcactttttatggaaagtctttcactcatttctatctgcagtatttactgggcatttttccacgccaagccctggggatacagagttaaataaaatagaagcttaatccaggcatgctggctgtaaagttcacctttcggctcctttctgccattcttattagggtcttgccccatcttggcagcaagcctgctttaccattggagacctcagctctgattacaatacgtccgtgatcaacatgccctaactggttagcagatggcagctgcatgaagtcactgggcccagataggaatcaacaagggagattaggtaaagtgcttatttgaggtgctgtcagggcccgtggcaaagggttccctcattccctctgcagttatttttcatgcacactcggattacactgctcggtgatattacatctgcatgcgtcttgccctctgacacggcaaacacagatgctgcccaaatccttgtaaagccatatatcttaagtaggaaggagcatctttgcaggggaggtgaattgatttgcaaagcagcctgacacatggtctcttatttctccttgcaatcaaataattcatctttatgcccgtagggccgtggtgaaatttgaacctgaccaaatcaacgactgcaaggtttatttgtagcagtgggatcagagaaattagccaagtgtattctaaaattatcaattgctgatcacatggtctggatgtgttttagtgcttaggggttggtggaccgaggctatggtggcatagtcctccatgaccaagggctgtctgcatgggtacgcagataaaacatgcactgccatggggtgacctgtgtgccatgcatcacacacagactactgtttaaccacctacatcataggtagatcctgcattttacaaatgaggaaacagagctcgagagaagttcaatcctcttccctacagagaggaaaggggaaaaaaatggactttcaagacagctgaaattcaaaacaaaacaatgttttaaaattgaatacagccttttgcattaaaattaccattttaataatagtttaaaagagagaaagagagagacccaaaatagtcaaactgaggttttgggttctggtgatagaatattaaatcataatgaagcatttaatgttttgttgttgttacaattgttgttttaccctagggctatgcaaagtagtttaaggatgtatttatttcagtggggaaaaaaagtggaggatatacatttggaggataaggaagcatgaattagggtggaggaagtgttttctggtctagctaaggaggaaaaattatagacctcaaaataggtgtcatttaatatatatctgtgaaaatgggccaaatagattgcctccgttaaagccgtattggatgttcaaatctcgagttacctgaaatgcaactgtacttcctatatttaaccaggctttttataaactgttcctcttaacacctcaagctgacaaccacatcctgggtggttatttaataccaagtttgactttcttcactttgagggtcctcaaaatagaaggtcagagagtagacttttaaaagtcttgcactgtttacaagtcagatgctttttggcagagtgactctcagctccccccaacaatcccttcttgtcgttcagtagtagatagactctatcagggaaaaataggagaaataaaataagacagcatatggaaggcattgctgaaagtctttttcacaccttaaaaacaaggaagaagagaaatgaaaataaaatagtgagcaacacctcggtgaaagtagaggtgtttgtacagttcagctgctgccttattcaaaaacaggaagaaaaacccactgcccaggtcagctggtgggtgatctccactgaactcctattcagaggctcagtttctctgcaggacagaaatgagaggcacaaaatttcatagctgtcttgcccctcctgtggtctgtaagaatgggaccaggactcctagttgtgaacccgaaaggatttccattaggatcaggaagtgtgagttggcttagaaaaagtaaagaaagaacagtgctgtttcatttatttatcatgtgtaagtaaactgggatttattttattttattttttattttttgtttcagtttcggggggtacatgtgtaggtctgttacatggatatcttgcaagatactgagatttgggcttcaattgaacccatcacccaaattagtaaacatagtactcaataggtagtttttcaatccttttctccttccctccctagtccccccttttgaagtccccagagtctattgttcctgtcttcatgcccatgtgtacgcagtgttgagcttcgacttgtaagtaagaacatgcggtatttggttttctgtttctgcatttattcgctcaggataatggcttcaagctgtatccacgttgctgcaaagaacatgattttcttcttttttatggctgtgtagtatttcgtggtgtatacgtaccacattttctttaactaatccaccattgatgggcacttaggatgattccatgtctttgctgttgtgggtagtgctgccaagaacgtgagtgcaggtgtctttttagtagagtgatttattttcctttgaatgtatacccactaataagattgctaggtcaaatggtaattctatttttagacctttgagaaatctccaatttatttttcatagggacaaggttgcagagaaaagagaagagtgctgtttcaaacagttgaaaccattcctacttccaaaaagaatttgactcaaaagggaatagtacactacatataaaagacagatgtatttaatttgtgtttcgaactacatatcagaaattagttagaagaagatatgagataaatatacctggaaactttatgaattatttctgacatctagcattaaatttagctgggtttcctgggagtcaaaagcaaagagttttcaaccaaaaaaaagaaacagaggtgtatagtaacacacctctgtcctgcaacataactgtaagaatttatcagattatatatatatatatttatcagattatatatatatttatcagattttatatatatatatatatatatatatatgcatatgtttgtatataaatatacatgtaaagacccaaaactcatataaaaagacaaggtgatacagcattttaaaacagtttactaaaaataacaaaacattcttccatcagtcatgcatgccttatatttatgtagatacaaaaatagagtttgatattaaacaatactccaagaaagccatttctgcagagttaaaaaatacgtaggttcagttccttaccaacacgtagacatgttgtgatgaaagaaggaaaggaaggaaggaaggaggaagggaagaaggagggagggagggaaagagagagagagaaaaggaagagaaaggattttctagaaaaagaaaggaaggagggagggaaggtaagaaagaaattaattcccattttagagtaagactggaggcagagtggtcacccagatgaaaatgaataacccaactgtgtctttcttctggtgcctccacgtggaagtgggctgccacaatacttctaaagagaattggcatttttctttaaataaggaggaggatgaggagagagacgacacaaaattcactcacagaagtgaacataaattctaacattggtaaaactttgtctttgttttaaataatcagtcagttgtctcaatccataaaagagtatctcttgtacaatgtctgcttttgagtgattcacttcgatgcgtactgaaaatatacctttaagtagttgagtgacttgaaatattggtaaatgttctttaatattttgtctgtcagtgttagagactatcaggttaaaacaaagatattctttctttcctttttgtttttgacggagtctcacactctgttgcccaggctagagtacagtgatgcgatctcagcttactgcaacctctgcctcctgggttcaagcgattcttctgcctcagccttctgagtagctgggattacaggcacacaccaccacacctggctaatttttgtatttttagtagacacgggatttcgccctgttggccaggctagtttctaactcctgacctcaggcttcccaaagtgctgagattacaggtgtgagccaccatgcctggccaagaatattctttctaatatgatttagctaacaggttcagcagatttttaaactcactttcaaatcatgataaaattctttaagataaacatttgtcttctgttttcccctgagagtggtttagcatttatggagccctgctttgtgctaatgagtttatatgccctgtcttctttaatcttcaccacaactttatgtaataagtagtctccaataaatttaatcacataattacttaaatggcctggcgagccgccttacctagctggccaggaattccaggagtcaggcttcctgatctaaatctgtcctggtcccatcttggctgggtgccaccagcagcaacggcacactccagcttaaatatcagtggggataattctaggccgtttgtctgcctggttcttccaggatagaggcagtgatttcagtaatctcttagggctgggcacggtagctcacgcctataatcccagcactttgggaggccgaggcgggtggatcacctgaggtcaggagatggagaccatcctggctaacatggtgaaaccccgtctctactaataatacaaaaacaaaattagccgggcgtgggggcaggcgcctgtaatcccagctactctggaggctgagacaggataatggtgtgaatccgggaggcggagcttgcagtgagccgagattacaccactaccctccagcctgggcgacagactccagcctgagcgacagagtgagactccgtctcaaaaaaaaagaaaaaagaaagaaagaacctcttaggcaactctcatttcattatccaggtacaaagacaatgagtaagaagagtattggggttgggaggaccagtcacccctgtgtcttaagatacttctcagttttctttgttgcagcaaatattactgcagagttttagtgcattatagccttcttaaataaaacttgcccaggtgcagtggctcatgcctgtaatcccatcacattgggaggccaaggcaggtagtttgcttgagcccaggagtttgcgaccagcctggctaacatcatgaaatcccatctctacaaaacataaacagaaattagctgggcattgtggtatgtacctgtagtcccaggtactcaggaggctgaggtgggaggattgcttgagcctgggaagtcaaggctgtagtgagcaaagatcacaccactgcagtcaagcctgggtgacagggcaagaccctatatcaaaaaaaaaaaaaaaaaaaaaaaaatatatatatatatatatatatatatatatgtatatgtatatgtatatataaatttaaggaagcatagaattgaagaggctattccaaggtcacatgacttttaagtggcagaaacaggggaattctgtctaacacaatccaatttatccatctcaagaaaagagatatgccaaagagaatgattattaaattatcattaatgtgaactcttgtaattactctcataattttctttaggcttatcccattgggcattgctaagtattattagattgtgattataaatggattccgccaggcatttctcttttgctctgtggcagctctttctctagagaacttggtccctggggatgccatcttctctgtcttcactcggtgaggatggactttaggatgcctcacttctcttcctgagattcttgcttccttcttccttaagggccactgatgagcaatcagtgagtttcaggaagaaggcattcaggctgatttcagacagcctaaggtcagtgtgcaagttagtatgtacctgtgtcttattattgaactggtgaatgaatgaatgactaggtcattatgaatttgtagatcagggttttgaagagtttggcaccggatttgaaagccaatgttctcttagtacctaccgctttcttttcctcaccttcctggatttcctgctcttaaggttttttgtttttgtttttctctccaaataaatggtatttattaaataaaaattcattttctcatttatcaaccagttgcagtctttggatgttttaattatataaaaaaagcatggaaactgggcattttaattagcaagtacagccttgacacaaataaaggcatggctttggttatgcagtgcatttatttggttttcttgaaataagaaaaaaagatttcttctccatcaccagagttgctgagtttgacagtgtgaatgagatgacctctaaggcctctacttatagatctgcacggttgggcctgggagctgtactacctcagctggtgggtgataacttactcacagtctgtgctgtgtcctgcactgtccattatctgcaggggtggtactgctgtccccagggaagagaatgctgtccacaaagagccagccatttatactattaaaagaatacacaggagttgaacaatgagaacacgtggacaacgggaggggggaacatcacacaccggggcctgtctgggggtagggggaaaggggagggagagcattaggacacatatctaatgcatgcggggcttaaaacctagatgacgggttgataggtgcagcaaaccaccatggcacatgtacacctatgtaacaaggctgcatgttctgcacatgtatcccagaacttaaagtgaaaggaaaaaaaaaagtttcatcaaaaaaaaaaaaagaaaaagaaaacaccggaaaaaagagactctcttccttgaaggatttaattccaggaattggagaatgtcttgtacatttcgagaaggcaatatagaaaatgcagtgggtagcccaggactcctggtccaggtaaagcaggccttgttgctattcccctggaccatgatattacatgttgggatgatggggtcttgtgatactgattaatttaaggctgcatgatgatgagggaggaacaaagatgttcttgagtcagtacctgccagagtggctgtatcctggtgttgtaatatcaaataattctacattatttagtaaatagccctgcccgaagcctctcagtgccacacacccactgggattcctgtgtgatttgtcacctggaggaacatcacctgccttggttggggagaggaagcctcaggaccctgcaccagggccatgtgacaaatacccattttgatagttcagtacccgctattaaatatgccgaatattattcctgaaaaggggcatggggataattacaaaaacatacctggttccactctcactttcgccatttaatagctttgggtctacaagtaaccaccccagatttttctcctcctctatgcaccagtcatatcaagaattactgtaacttcataggatttttgtcaggacgctatgatgagaagaacatatgccaaggagacagttttctggcaaatcagaggcctgtaagaaatgatggctttttgcttgtatgaccaagtctcttggagacaaggcctcatgtatgaactctgaggcatgagaaggctcagaattcaccccatcttcagtcttttatttgaaaaagggaagaatgatggaaaggggaggagagagtatataaaacacgaacggggatcctagagacttgaatttctagtatgtactgcctctggctaatagggatctttgacacatacgctttttctccctttccagctggccctgttgcttaaagtggcagaagtagatgtcatgttggcagacagttttgttcactgtcaaaactgggtttatctaatgtgtatttgaaacaaacaaaaaaaaatcaataaaatgagcagctttgggagccagggtgaaggcggttgagataggacagaactccagaggactcttaaacattattcaggaagctctgaagctccctcagtctgggattccagaaaaagattgattaggcaatagtttaccttagaccatgaggagatggactttagccagaacacactgaaaaacacgagaaaagttggaagaaggaattatttttagtgttctgagaatgctttattgatattcctatgagagtttcattggttactgacgctgtgtactgattgggtaaattctagcatttttacactcctttgtttcaccctgtttgttcattcattcttccgttaaactaccattaagcaactaccatatctaattttaaggtggtggacaaagaatcaaacctaagttggggaatgtggcctctggtgattctcagttcttggtagccatgtctcagcatagtcttctcggacacctaatactactgacctgtataatcgatagggtattgcagacatcagagcatgtgacttacgaggctagaccataaaaatattgaggcttctgccttactgatgtggatcattcactctaggaaaagccagctgccatgttgggaggatactcaagcatacccgtgtagaagaactgagcctcctgccaacagccatgtgagtgaaccacgttcgaagttgattctgcagccctagttaagccttgaggtgattgcagcctttgctgcaatcttgactggaactttatttgagcccctatctagaaccaccgagctaagctgctcacaagtttctgcaccacagaaattcttgtgcgagataataaaagttaattattgtttcagcccacttagttttgggataatttgttatacaacagtggataactgcccattcaaagagtctaaaccattaactgttcagcattaggtaagaaaaccagttaattgttactttcttaccacctaccccagcaccccagcaccccagcaccccagcatgaccaccatttagagggagctgcgcttttgcaaaggtacataggacactgtctgttgcttctgtacctcttgcctcatcagttagtggtgtgatgtgtttgcctgacaaataccatctaggaccctggctgcatgagcttgttgagacagctaaattttacaggtagttggggtttcaccatttaacccagttaactcttctataagtgccgtattaaagcaggtggtgtattttgaaagacgtatgtaaaaacatttgtatttatttatatgaatgaatacattttatttatttatataaatacattatatttattcacataaacacattttatttatataaataaatccatttttatttatttatataagtaaataaattttcctataaataatctttctgattgacagatagcgaccttcctgctatgtccttacatgacagaggaagagatcatctttcttcagcctcttctgacaagtccaccagtctcattcatgagggttccactctcatgactgaagtacctcctaaaggctccccctcctaataatatcaccttggagattagggtttccaaatatgagtttggggggacacattgattccacaacactgaccttctatcagatcagccaggatgctctttttcaaacttctgtcaatctttccccaccttcacaatgtgcccctattattattaatatttaaaatattgaagatctaattaatgttgaaatttttctttaaatcaattcatagattcattaactttgttttaaaaggaaatgttctatttccatcgtaaagggaagatcaatatgatttgccacatatagatgaagataaacctatatacaaagaaaatagaactatagtaattccatgtagctattattaccagagaatactctaagcccaatgcttgtgttctctttgggcaaatggaagatgagccacttgtagagaggtattaaaaaccaaagcaagatcttttgcaagtagattaattgggcaagacaaagggaataataactatgtcaccaaaattatttaatgcagggtccaggagccaccttaatcatccataaattggttaggcatgtttattaccacagattggaagcaggcttcccccaagtgtgtttccctttgtaatgccagtgtcgtaacgccactatctatacttttcaacacaattccaagtgctacctctgcatggcagaaactatcaaccgtggatggtttctttttagcttgtccttcccgttctacagcatggaggttaagagctctggctttggttccaatcgtgtcccctttcctccctgtgtgttattgattgacctctctgagcccattgataaatggagttaaaaatttatactcactggggtggtgagaaggttaagggcaatgatgtatacaagacattagcatttgctataaggaggatgtatctcagttgccatatttgtatcactaaccatttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctatttttgtgggtcaatatattcccacttttgatttaaggtagtacaagttgtatatgggtgccagttagggattcctggctgatctgtgcaattttttcagtgaagttatatgtggtgcttagtggtgactatgggaagattacacggagaagtgttagaacagggtaatcaactgggaacccatttcaggtgaatgccaagatgttttgaaggtgggcatggcagggaaataacaggatgccatgcttggtgagaaatgaattcgtaagtgtgcactgtctgccataaagagccaggcaaggcacagaaaatattcttctgtttctttttctattctaccctctctctgctttttcttctctcactgctgctgaagcagtgagagcctgttgagttaaaataagccagtgaggattttggtggtgtttgcccttgaagcctcttgacatacagtgtcatcaaggagcagtgggtgagcctgcccatatctcgggcacaaacctaggtactcattgaatcctttaaactaaccctctaaagaattctcaatctgtggatgagaaatggcaacacagggatgttaaactgcatgcctacaatcatccatttggaagaagcagggctggaatttgaacatgagactgtatgctccctgttgtagtttcctatggctgctgtaaaaagttagcacaaatgcagaggcttaagacagcacaaatgtcttatcttacagttctgaaggtttcgctccagagtgagttttatggagtgaaaatcaaaatgttggcaggccttaggggagagtccattcctttcatcttccagtctctagaggctgctggcatttttcagctcacggccacagcactctaatctctgctttcactatcccttcttttttctgtgactctgaccttcttgcttccctcttacaatgacccttttaattgcattaggcccaccaggctcatccaggatgtatttgtctgtgttcacactagtgataaagacatacccaaaactgggtaatttatcaacaaaaagagatttgatggactcacagttccatgtggctagggtgggtgcacagtcatggcggaaggcaaaaggcacatctcacacggcagcagacgagagagagtgacagccaggtgaaggagtttcccgttataaaaacattagatctcatgagacttattcactaccatgagaacaatatgggagaaatcgatcctgtgattcaattatctcccaccagggtccctcccacaacatgtgggaattatgggagctacaattcaatatgagatttggatggggacacagccaaaccatatcacaggatagttccccatatcaaggtccttaacttaatcacacttgcatttgattttatcatgcaaggtagcatactcacaggtgggattaggacttagacaccttcagcaagaaacattactcagcccaacacactcctcaaacctaagcttattcccaatcacacagtcaggagaggatgcccacaatgcacttggggttttgtgtctgtgtctcccctccaagaacaggtacttgcccttgtctttggagctcacagccaagtcctacagtcagcatcagacggcttgtctcaagctgctgatttccgggagcaaagctgctgtgggacatgagactctttgaggcagaatacctctcatgcctggagagcattacaggctgcattagtctgttttcactctgctgataaagacatacccaagactgtgcaatttacaaaagaaagaggtttaatgaactcacatttccccatgtctggggaggcctcacaatcataatggaaggggaaaggcgcatctcacgtggtggcagagaacagaagagagcttgtgcagggaaactccgctttataataccatcagatctcatgagacttattcactatcatgagcatagcacaggaaagaccctcccccatgattcagttatctcctaccaggcccctcctacaacacgtaagaattatgggagctacaattcaagatgcgatttgggtggggacagagccaaaccatattacaggctaatgactgagcgggggctgtttcttgttgtgttcttataagaactattgcattttctttttcttccaaatatagttaatggcctcatcttttctggactaggtttgtagtagaccataagcaaaagagttcagaaagcacggcctccaagaagtcggatctgcttgtctttatcaatctgtttggattttcctggcccatttactcacaaatttaaaagacatgatgagttttcagggagaactctttagcatttacattttaatttagttttgtttacctgtttagtgccctctcggttcccagaccatcaaactcaccattgtcaccggggagaaatttgtgttggctgaaatctgtagtggttggtctgctgcttttctttctctgctcatctaccctgatagtttccctgtggtttgtggtgggctcacagctcttgacctcaggactctcgctggtctagaggagattggtttgtgggggcgtctgacatgtttgggttctttgtgacatctgggccacccggttgagtctgacaagaaacacttaatacctccttggctttgaagctctcctttgtggcactacaaggtcctctttgaaatcccacattcttttttggatttaggtattaaccccttggtgtgaggagaaagataattgtcaacacacttaggagagaaatcatgcagtaaagctgacccgacatagactaacttaaaactaactagttcattagtgctaacttagttcattagtgctttatctccttgtgtgtgtgagtgtgtgaggggatcaattatatacataagacaaagaccacctaggaaatgtttgagaaactgtgcagtgaggatgaatcaacaagtaaatatcatgagaatttcttagattgaagaaatattactcctatttggtgtcaactctgtgctggccttttcactgaagttctctgatgtaactgcccacagtaatcctgtaaggtatggctaatcatttccattttatagattaggaaaccaaggtcaaaagtggtgaattgatttgaccaaaatcacagacccaggaatttcctcagccaagagcatacagcagctgtgtcttaagactgtgccctttcatccaccctcttggtactcaaagcttggtccatgaaccagcagcttcagcatctgctgagagcttgctggaggtacagaatctcaggcctgactgaccccaggcctgctgagtctgaattttaaccagagtctcttggtgactcgtgtgtactttagaaggggaactgctcaccgcccccacttcccactgagtcgaatagacattaagtgagccttccttatgtgctcagcctgtggtgaggctgcaaagacaatacgacccagcccctgtaatgcaaaattcagagcatagggcagcacactgctgccatgagtcgaggtgacacagtactaacagtgggcacagggggctcggggcacagaggaggggtgcttcccagggagactgcccgttggagcttactcctaagctaattgggaggcaggaatccactgtggctgagaacagcagctctgaatttgcactgtctggtttcaagtccaaattctactacatcccagctgtgtattgtggggcaagttacttaacctctctggcctcagtatctgtatctgtaatatggggaatcataaaagcacctacttgttaaggcatattaaatgcaacgctactttgaaggactcatggtagttaacacccagtttggtaagtgttattattgaaggctgagaacagaacgacaaacaacaatcacaacaaaaggctggggaagattttcctggtggggggaccagatgagcaatagatctccatatgcagaggggtaactgagtacgactctgggacttacactagaacattcatattgcaataaagcagatttttcctgagcacctactctgtgccaaagcactattgtaggctgtggagatagggagctgaagtactgaaagcgttacagtcaagggccagaaaaccattgttcaagcagttggcgtatggcttgatctgtgtttattacaaagcgatacttttccttctaagtactgctttacctgcatcctgcaaattttggtatgttgtattttcattctcattaattcaaaatatgttccaatttcccatgtgatttcttcttcgaccctcacatgtttattacagcatttacttgtttctgttcatccagaactcattgaatacctgctatctaccaggcagtggcctggtcacatcttctgacctcaagtagtttatagtccaaaaagacattggctctttgggatagaggcactttttgggggagagaaacatgaatgcaattttttacatagagtatgaaactctgttccaaatctctcaaactcaggttctttgattcttaaggtatttttcactgccgagttgctgtcattgaaacaaaatctgtcctggtcaccactgtatgcccagcacctagtacagtgccctgaacatattaggtactcattaaatacttgttccacgaagttgttatttggtattcacgagttttgtctcaattccttttgattcttcttttcacccatctcatgttgacttaatttctccagcattcagttaagacctagccgaagcataattgtcagcatagtagagctggctctcctctttctaattgccctgcagagtttttggggagtctgtatgcaattgtgtacaccccaatgccccaaaaccctcttctatttcctttagcactcttgagctgaagaagccccactctccctctgccccacatctattgtgggctgggatacatgttgggcctctgcccagatcatgcttggagtggcaccagctgcgtaggatatgtgaaatatttgctcagagagatccagaagggttgatgtgagtaggatcagctggtgctccaggataaaaatcgtgtcaccacttttgccgaaaagtcactgtgtttctcctgtactcagcaggttacagggtgccatattgttctcagtcttccggctctaccctgttttgaagtgcggccgggtgttgttaaacggctccgccttcctgccagaatttctccgtggggaggagctgccacccagtccagtgagtatggccttttggtcagcattgcagaacctggcaagtcctaattccctgtgagcttgacacaggaggccgcctcctcctccaggcccacttggaggcattctgtcctcttgttggaagggaaattggtatggtagggaggtgcttcttctgggagtgggtttgtaaaattaagactgttttcatccaaaccagttacctgtttgtctagaacctgtgttctctgctttctgcctcttgtgttgacatttctcctttggccttcatctgttactcgctcacatgtgccgtgccccgggtgggtttggaagccatgctgctatggtttgattcctggctttccaacattacctttgataaccaagacaagtggcagtctaagcctcagtttcctcatctgcaaaatgggtgcaattctagtacctccttcctaaggctgtgaggattcaatgaggtactgcttgcaaagtttctagcacagtgtcttgaacacggtaaacaacttacctaggtctgatctcatttgatattgttgctcatagcaaaggtttgttgagtttactatggatataacacttgttcttttttaaaataacttttaaaaacgcaagtgttgaattatctgcattgtgcctttagggcatacacatctgcttacaatattttttgagctttcagaaaacttaagatatggttgagggatgcaggaaggaacaggacaagaacccagatccctgcccaacaggacagtggaagggaagtctcagcatctcgaaatgagtgcctggagaggatgggtggcggctgtgcggggatgtggtagggtgatggtccttgaaggatgctgcagatcacagtggccccacagtgtggggattggggtgggatatgtgacaacaaaggcatccctggcagaggatccagcacgagcaaaggcagaaagtccaggaagtgtcaggaatgagaagagcccagtagaggatgggcttagggacagtgatgagaccttctggtagaggcgttgaacactagggtgagggctttgctctgacttcaggaagcaggtgagaggccctgaaatttccacgtaagattcggggccgggcacggtggctcatacttataatcccagcactttgggaggctgaggcgggtggaccacctgaggtcaggagttcgagaccagcctggccaacatggtgaaaccccatctctactaaaagtacaaaaattagccaggtgtgatagcgggcgcctgtaatcctggctactcgggaggctgaggtgggagaattgcttgaacccgggaggcagacgttgcagtgagccgagattgtgccactgcactgcagcttgggaaacagagtgagactctgtctaaaaaaaaagaagagttggatcacagcaaaggtgagctttaatgagttcactctggcagttgtgccgaggagggactggcatggagagaaaacagaggcaaaaatcacaacctctgtcagagaactcatcgcactatttctgtcctgccctgggatggtggagcctaagggaacagagaggacagagtgggtggcacaggcattgcggaggcagaaatttacgtggcttccatgcccattggtgtgaggagtgaggggtgatcagggatcccagtggcttgaaagtataacaaaagtatgactagatccaggaaatacagctggagagacccaagtctgcacagaaaaggtttacagagcccaggcacacagatgacatgagcagttccaaaggagtgggacggggtgaatgatttgtggtcagaggtgtggtcacacataccgtcccctgatagtcggtgggaactgggtcaggttccatttgccaggggcaggacatactgcgtgccttggccttttctgggctactcaaaaaaggattccaccaggtaaacttgaatcacctagcgctggtagaaagccttgctcttcgtcatctctcctgtgtgtcgctagccttattaaaatgtgcagaggagaccgggcatggtagcacacttgtaatctcagcacttggagaggctgaggtgggagaattgcttgaggctatggcttcaaaaccagcctgggcaacacagcaagaccccacgtcttaaaaaaatttagccggctgtcgtgtctcctccgtgtagtcccagctattcaggcagctgaggcaggagggctgcttgagctcaggaggtggaggctgaagtgagctgtgattgtgctgttgcactccagcctgggcgacagagggagagcttgtctccttgtctctaaaaaagaaaaacatgctcagaggccttgtgagttagctctctccaaagtttttaagacaaggaattcagttaatcaagtttgttagacttgtttgaaaaaagggcctgaacaggctcagagcaagggcagatcaagctcttccacagattttaatgttcaggttttgtgacctttactttttttattttggcaaaatgtacacaacttagtatttatcattttaatttataagtgtaaaattcatagtcattaaatatattcacaatgttgtgtaaccatcagcattacctatacctaaaatattttcatcacatcttttaaaaaataactgccccttcctcacttccccaagcttgtggtctctggtaacccctactttactttctgcatctatgaaattgttttcaaggtcaatccatattgtagcatatatcaaaatttctttctttcttcctctccttccctccctccctccctccctccttctctctctcctttcctcccttccttccttccttctttccttccttccttccatttttgacagggtctcactctgttgcccaggctggggtgcagtggcacaatcaaagctcactgcagccttgacttcctgggcttcagtgatcctcccacctcagcctcccaaggagctagaggtgcatgccaccatgcctggctttttaaatttatttttattattatttttttatttttagtagagacagattttgccgtgttgccctggctgatcttgaactcctgtgctccggtcatccacccgcctgggcttcccaaagcgctgagatgactgcgccaccacacctgccacaaaatttctttgttatggctgaataatgtttctgtgtgagtgtgtgtgtgtctgtgtgtgtgtgtgtgtgtgtgtgtgtttgaataatactcctatgaacattgtaccaatatctattcagatctctgctttcgattcttctgcatgtatacctaggagtgaaattgctgcgtcgtttcgtatctgtgtgcttaaccttttgagaaactgccaaactgtcttcaacagcagccgcatcattttacattcccaccagcagtgcatcaggattctagttgctccacatctacccaatacttattttacttaaaaaaatagaatagccatctgagtgaagtgttacctccctgcagtgttgattcccatttccctaatgatgttaagcgtactttcacgtgcctactggccgtttgtgtatcttctttggagaaagtaacatccatttttgatactcacatggctttttggttctatttttgctttcttttggctaatgataaccttccagcaccacgagtttggactgtgctaatgtcttctagtactgtttagaagttgaggtaaaaagaaaacggtaattgaaagagacagttgttgtttacattggggaggttggtattccaccccctgtgctttttcattagctgtattgtattcttattatgtgttttaccgggtaattgtaattcttggctttggattttgtcccttttttaggctgcggggcgggggggtcggttattttataagcaaagaagtacagccagtatgattctgaagcaactaggtcacagtagaaaaaagttggagagtgaaatctcaagcaagccaaaaagtgatagatgagttaaaaaaaaaaaaaaaaaaaaagttgcctggcttggtgcagtggctcatgcatgtactcccagcactttgggaggctgaggtgggcggatcatctgaggtgaggagtttgagaccacactggccaacatgttgaaacccgctctctactaaaaatacaacaattagccaggtgtggtggcgcacgcctgtaatcccagctactcaccaggctgagagtggaaaatcacttgaacttgggaggcaaaggttgcagtgagcggagactgcgccgctgcactccagcctgggtgacacagtgagacttcatctcgaggaaaaaaaaaaaaaaaggctttggagcttcctaatttctaaatagatttcctttataattttcagaggttgtgaaattaactctgtagattggggagtgtagtttgtcactctaattgcccagcgttttaattatcggcgtgttttatgcttttgtgaaatgctcatttcacagcttgctggtgggtctttttgtggaacgagaaagtgaatattcacaccagaaatgaggtactgaccctgaagggctttccagtcaaagagaaaggagagcatgacccgccaatgccgttgtttgtaagcaggaagctgacgctgcgccatggtgtaggggaggaggacggtttccattctgttttgagcatcagaataaaaccaagcaccagaaggtgtggttcaaagatgctttcctttttcagtctctggtcaatttgttgttatttttcttcaagagagttgttggggttgggtaggcgcaggggccacaaggccatctttataaggctctggcatttgatagtgaggtattttggtattccaaataattggtggaaggatggaaaggttaaatggaaattatgtaagggctgcaaagagattcatatatgactatttcatgagtgcttactatataccaggcgctgttacagcccgtgtaatgccacctgggagttggggggagtcaccatcgtccatccgtctgtccatccatccatccatcctgcctccctccatcctttctctttttcacaatgtctcttgctccgccccctctcttcccctccttccttcctatccagtgcttgtaacctgtcaagcacatgttgtagccattggggacatcgtggtaaacaaagcaaagtccttgcttgcattctgtgacagatggagataaaatgggtaattaacaaatgtaatccctcccacccaccccccacattatttatttatttatttatttatttatttatttatttatttatttatttatttttaccatgtctgttactccatcagtcaggatccagttaggagacagaaactatatcataattttaacagggaagatttaatattaagaattattagctacaacagggttttggctactaaagggtaaagagaatcaggccgagcacagtgactcatgcctgtctgtaatcccagcactttggaaggccaaggtggaaggatcgcctgagtccaggagttcgagatcagtgtggacaacatagggaggtcctgtctctacaaaaaataaaaaataaaataaaaaaataaaaataaaaataaataaaaagtagttgggcgtgtgtggtggagcatgtgggggtcccagctacttggcaggctgaagcaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaaccccgtctctactaaaaatacaaaagtgagtcggggttggtggtgtgctcctgtagttccagctacttgggaggctgaggcaggagaatcacttgaatccgggagccagcggttgcagtgagcttagattgcaccactgtactccagcctgggccatagagtgagactctgtctcaaacaaaaaaaaaatttaactctaaagaatccaagaatacagatttgggagcagccagtaccaatgggggatggggcagtacacccaggaaagagcaaatctggggtccccacgggccaggactgggatctggactgggccatggcccattggatggcagaaaggttctcactgaagcccccataaaggtgggactcactgggaaaccgctctctgtggtgccagggaaggacgtctgtgggaggtgcctaccaaggaagtctctggaaatcagcctgcaggggtggagtgccgggaaactcccgccccctccccccctccccgaagtgaaccgcccacagggagatgcccctatgggagcttcgcaccagaacccgtctgcgccagtgtccctgcagcgccctctactggcgaagctggacatggcgtccgctggcaaaggggaaactcttctttcctcccaagccgagcaatgctaaatgtgcctggtactgagacgtcatctgtggacggttggcaccgatgctaatcagtgctatgggaaaataggcagagcgaggagcgtaagaattattatgtgtgctgtttgatagagactgtacaaggaagacctctctaaaaaggtgacatttggagcagagacatgaaggaagggattgctggaggcagaacattctaggcagaaggaaccgcacgtgcaaaggccctcaggtcagccggcatggcatgcaagtaagccagctgcaacacagcaggtgtggatgaagggaagagaattagcatttggccagagcacgcattttaagggatggagatccatttggatagtcttgaacacagaactgaccggaactgacttactctttgaaaagatcgctctggctgctgtgttgagtggattggtaagggataggtggtgaagactgaaacagggtatccagttaggaagctatcacagtgatccaacccccagcttctgttgaggttgaagaacatgcatgcccaacctaaatatatgttcaaaggtggttattactgtttgaggtgatgaaagagttttggagatagaagtgatggttgttcaacatcatgagtgtaattaatgccacggaattgtatccttaaaaatgcttaaaatgcgctgggtgcggtggctcacgcctgtaatcccagcactttgggaggctgagatgggcggatcacttgaggtcaggagttcgagaccagcctggccagcatggtgaaaccccgtttctactagaaatacaaaaattgggcgggcattgtggtgggtgtctgtaatcccagctatttggaaggctgaagcaggagaattgcttgagcctaggaggtggaggttgcagtgagccaagattgtgccactgcacttcagcttgggcaacagagtaagactctgtctcacaataaataaataaataaataaataaataaataaataaataagagttggatcacagcaaaggtgagctttaacgagttcagtctagctctctcacaaaaaaaaagttaaaatgacaaattttgtgttacatacattgtactacaataaaaaccatttttttgaaaagaatagtacaaaaatgatacttccctctcagtgtattttaccaagggattattagtgtatatgtgtgttcttactggaaatgttaattggacctgtaattctttttttaacttttattttgggttcaggggtacatgtgcaggtttgttatataggtaacttcatgtcacaaaggtttgttgaacagattatttcatcacccaggtaataagccttgtatccaatagttatttttctgatcctctccttcctctctccctctaccctcaggcaggccccagtgtctgttgttctttctttgtgtccttgagttttcatcatttagcttccacttgtaagtgaggccatgcagtatttgattttctcttcctgcattagtttgctgaggataatggcttctagccccgtccgtgttctcgcagaagacatgatcgcattcttttatatggctgcatagtattccatggtgtatattcactactttttttttaatccaatctgtcatttgtggacatttaggttgattccagtagacgtgtaattcttcttggaaatgttaatcttgatcatttggttaatgtgatgacttctgggttctgcagtgtgaagttattatcttcccttttgtaggtaacaaatactttggaagagattaaacaaacaaataaaaaagtggtgattgttattaccagcatggctactactagctaattccaggcttcaagccactggggcataggcatatgtttagctcattccacaggaggggaacagaggctcaaagaacctaggtaagttggctaggcgcggtggctcacacctgtaatctcagcgctttgtggggcttaggcaggaggattgcttgagctcagaagtttgagaccagcctggacaacatagcgtgaacttgtatctacttaaagtaaaaatcaaaaaaataatggggtgcagtggtacatggctgtagtcccaattactcaggaggtggaggtgggaggattgcttgggcccaggaggctgaggctgcagaaagctgtcatcatgccgctgtgctccagcctgggcatcaaggtctgttttgcagaccttgtctccaaagcaaaacaaacaaacaaaagaaacaaacaaacaaacaaaaagaaattaggtaacttgctcagtggctagtgagtggctagattgtaagcttcatgagggcaggggactttgacgattttgtcggtatcctaagccgctagaacagtgcctaaacatttgttgggcagttaatatatatttgttctattaataagtagagcccgagtttgtgttctccgattccacaccccatgttccttctactacaacttctggctctggcttctggactgtcagtcattagcactccctatccctaaggtttcaggaatgttcagctgtttcctagcttggaatggaccatcctctggtcccacccatgggtaagtcattggctgcagagcgcagacatttggctcccctcgggacattcctccctcatttaaaacaatgaggcgggcagcagggtactttgtcccttgtgttagctgaagttggaggatgctgtgttgatgggaaaacgctgttactattcttagactagtggggctctcacttattcatagctccgcactcgtgggtggaatgagaagttataatagagtgcaggtgcctctcattgttttccgctactcactggatagtgtttattaaaaacgaaatcacagtggtgtgtctggagttgaagtctgaacaaataacccaaaatgaggagtccctggaaggtgggcaggaggcgacaaacaaagagaagcaaaaacaagtttgagctaattgggatcaggcagtactttgcatgtgagttctgaacagggagcttggctgcaaaacgattattgtatttaacttctgttggcatcattcgcatacttgtatgggagatccagaattggaatttaacacagttttcccaggcccttcatggaatttgaaaacatgactctgaaagcatgtggctgaaatgagactctttcacactgtttaaagatgcatgtgcatatgttggtgtccacacatcaacttaattttttcatgttccttgaaggaagcccgtctaggtccttctgaaagaagggctggagatttttattaaacattacttctaggctgggtgcagtgactcatccctgcaatcccagtactttgggaggccaaggcaggcagatcatgaggtcaggagatggagaccatcctggccaacatggtgaaaccctgtctctactcaaaatacaaaaattagctgggcgtggtagcaggcgcctgtaatcccagctactcaggaggctgaaaaaggagaatcgcttgaatcagggagtcggagttttcagtgagccgagatcgcgccactgcactccagtctggtgacagagcgagacaatgtctcaaaaaaaaagaaagagttctgaatgatgataggtgttggaatccacgttggtgtgtctcatgtcattttttcgggcagtttcttgacagacccattttgtgtgtgtgtgtgtgtgtgtgtgtgtgtgtgtgtgcgcgtgcgcacacgcatgagcctgtacgtgtccccctccccccccacacatatgcacataagatagcataaggtagttcctggcacatggcgttgttcttaaccatgaggtgctcccaggctccgggcagttccttgaaagactcattgtctgtgtggggggaggggaggctgtacatgtccccacccaacacacacacatacacacacatgggcacatatgatagcataaggcaattcctggcacatggcattgttctgaactgtgaggtgctcccaggagatcttgtgcttcctatcacatgcccattctgcaagtccatccccttattgagcagatgtttaccgcagagcactaagacagatggaacgtcaccgttgcccatagcactcatggacagcatggggtcccctgtagcagatatttgtggtgtatgctcgaagaggggctgcaggtagaactagaaaggtaggtaagttgggcagatggcgagagacatcacagccctcactcctgagggtggggagccatctcaggctcaggagaagaagagtgacagagtcaccaactcactccatcaaatgtggctgtatttttagaagtgtctggttcctgaaatacctcaattccttttgcctgcctggctcctctcctctcttctgcctgttcattgaactgaaagattatcaggactgtattcagcccggccaataatatcacaaaacaaaaatatcttgtgggtttgaaatttatgagtgttttgactgttcacagcaatgcctttgagaatcacagtgtgtcatcccctccccacccccacgaacatgtagtttttgggcaacttttcgatgagtaaaacagggcctgacttttaccccaaagtgatgttcttttgtggcttgtctactccaagaactgagatacccagactcatttctcatctcttgttgaaacagagaagtcactgtagcgccctccggggggtggggtatcaagggagagtatgggctttgaaactgctcatcccgtctacaaccttggagggcatggtgtttcactcccccacctctccccacaacttcaccctgctccaatgaggatgaaaatgtctttcttatagatgggacaggagccttagtaatatggtgcgagcaatggttcacataggggacaggtgttcattcaatggtgggtattattataataatcattagcatcattgctagtgactttatttttcctttagccaatggagcagtggcttttggcccactactttcgactgaatctatgagtgaatgtgatcctccgttttaaccctgtcttattggatgttggtaaacagtatatcatgagcccctgtaagagcttgaatccttcaaagacaaggtcagtcagtggccatcactactctaaacgtaagaccctgtgatgactgacacttactaggtttctcatttatttatttttctctgcaggacacagctatgtgttccaaagatggtcttaaacctataggagtataacaccatggctagttcagaaaaccttattccaacttccaaacttagaagatactgggaagtaaaagggagagaagggaatgcatggcttgggctaaaaaaatgattctgcattcatctcagaaggatgttttccagtctttctctagaaacaacttttgtgtctaaggattgtgggtgaacaacagcagcacaggctacattggcttggctcggtggttgggatggtttggctcttactgggcagtaagcacagtggctgggataggaccttggcatctcgtgcgaagcccctctgcctggagtcctgcctctgtgacacttgcttactgtgtgacctgggtcaactcatacctactgttcgtcagttttctcatctgtaaaatggggattccagtggttattatgagaattaaatatgacgatacataaatagcacctggaaaagtgtttaggaaaccttgacatgatgacctgtttagcagcagcagtgtgtgccatacttacctttatggaatgaacagatttggagtgaggatggatgtttagctcactttattagtctggtctcacactgctataaaaaactgcccgagattgggaaatttataaagaaaagaggtttaattgactcacaattctgcatggtcggggaagcctcagaaaacttacgatcatggtggaaaggaagctagtgcaccttacatggcggcaggcaagaggggcagggagggagagagaaagagggagggaggaaaccaccacatataaaaccatcagatcgcgtaagaactcgctatgtcaagaatagaatgggggaaccacccccatcatccagtcacctcctaccaggtctctcccctaacatgtggggattacagcttgtattacaattcgagatgagatttgggtggggacacagccaaaccataccactcatggcatctcgtttttacagagtatatgtgttttcagattttgcatgacattttaggataaatgtgatgaaaatgaggaaaattgggaatgaagtttaggtcagaaaagtttcagtgattattttttcagaatcattgtttcttggtttctagggtccaacatgccattgttcaatggctgtatttcaatggctgtatttcagaggctgtattttttttcccatctcttccttcctacttagaagacagtgacatttcctctgtgcctctcaggtgtcaatgccatccaacaggaatttgtacaaagaaagggaggactttctgatgatgttgtccaggacagtggccccatgtagctactgagcacttgaaacgtgactagtatgaccaggggctggacttttagtttaattttttgtaatttaaataatttaagtagctgatgtgtctagtggctgtcgtattggaaagcacagagtagacattgcaaatacagacgtagaaagacaccgtgcctgctgctaagaggcccctggtcctactgagtggtcagctgtttacactgacagtcccagcgtggtataataagcattaacacagagacatgtacagggtgctgagaaagctaatttttgcaatagtcaaaaaagacctcagggcagactccccagcacagagttccaagcctttacctaaaaaggtaatcattttataagtacctattatgtgccagatactaggataggcactttgcatagaaactcacatttcgactgggcctggtggctcacgcctgtaatcccagcactttgggaggccggggcaggcagatcatgaggtcaagagatcaagagcatcccggccagcatggtgaaaccctgtctgtacaaaaaatataaaaatgagctgggtgtggtggcacatacctgtagttccaactgctcagaatgctaaggtaggagaatcgcttgaacccaggaggtggaagttgtagtgagccaagatcgcatcactgcactccagcctgggtgacagagtgagactccatctgaaaaaaaaaaaaaaaaaaaagacatttacattttatctttactgtagctatggctgcctatcccaaggatgggaagtctgaagttcaaactggtgatgatccccaccccaagtcacacagttagctttatagttaaatcagggtgtgcctgatttcctagccataccaggcagcctatttcttgaataacctcccatcccctgtgtctcctttgtggagctcttggcaatactctggtgattggtaaccactgatacgccgccagcagtccacgcttgggtggaaggcaggtttcacgtaactgatttaccacttggtaaaggaacgaggtgacagcaagaccacaaactaataaatatgccggtattgacataatgtcggacctcagtatgattgatgcatgtgttgttgactgggatgtcacatgttcaggctgtaatcctggtctcagtatgactgtgaggacggggccaagtcatttcacaatttgggtgagtgttccaagcttctcagaagagcgacgcaatagaaattcaaggtatgaaattcaaggtgtggtctcagagtcattttatcttacagcttctctgctgtgttttctcagtatgtgaaatgggaacatcacttaccatctactcacctcctgtttgagttcaagggaaggtttgcagattggcctgaaggaagacttctcttgaaaaactcaaaccaaagagcacaccgccgtccccaaccctgagccatttctgtccttttcatggaaagggaactgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactccaaatgctgcttctgatctccatctatttcaggggatgaccagtctgaataaaaccaatgagcttaatctacttgtggaatgttatagccggaagggattcatagagatcactctatcgcctaaaattctctcttctacatatctcagtgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactacaggtgcatgccaccacacctggctaacttttatttatttttagtagagaggcagttttgctgtgttgcccagactggtcttgaactcttgagctcaagaaatccttccacctcagcttgacattacaggtaagagccaccgtgtccggcccccctttcttcttttttaaagtggggtattaaggctcagaaaagagtgtttctgccactgcagaggattgctgacattattagttgctcactctgtccaaggcattgtgctcagctctttgtacagattgtttaaccctcacaagtctatgaatagagtatattacccacttcattttaagtaggaaattgaagctcagggaatcgtagcagagggccccagttcacactgctgatcagtgatgcgactgggatcaccacagcccatctggttcagaagcttgttctcctaaccaggatgtgagagacattcttgtcctaggcagcacgttggtggcagaggtgggatctagactgaggctctcattctgtaccctctctggccccaaggaaggaaaggggaaggagaagggcctttgggactgggtggatgtaacactttctgccacctctactcttcctgctatagattaaaacagaagctctgaattgcagccacaaatcaataatgaaaagctaccagaccaagccctttcttgtttagtgttgtgtcttctgtgtcaacatctctggaacatagtcaatggcagtacccagtagaagccatatggatactttttctcaagtgttgaaataaattaatggtgtggccatggttctcgtacttcaggtccctgtgagcccctggggtcctacacaacttggggtaatgctatggtcacctgcatcccctcctctccagccctcacctggttttctcttctccttccaagaaaaaacacccataccattcttaacatctctggaagctgggggtcaggagagggagatccataaagttcttgtcttccccgactcaagaagcttaagggtacattcactcactcatgaattgactggtttattcattcactggttgattaattcattcattcactggttaattaattaattcatgtcatcctttggatgtcttgcagagctgagtgctgaaa

SEQ ID NO: 300 - DNA, 615344 bp, Homo sapiens
tcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttga

SEQ ID NO: 301 - DNA, 574510 bp, Homo sapiens
aaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttga

SEQ ID NO: 302 - DNA, 627094 bp, Homo sapiens
cctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaat
